United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 61

SEQ ID NO: 937 - DNA, 477021 bp, Homo sapiens
cctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgtgagttgcagttattttccttccagctttcttctgtgcttgctttagattgtttttctgcaaagggcagatgcagctgccctggctggtgggcagtggagggggatgacagccactctggctttgggcctctgtctgacatcacccagattcctgggtcctctcagttagcatttgccttttgtctgggtggttaaatttctcttgaaggagtaggataaacaccctcttgagtattgctttttacacagacacacaccacacacacacacacacacacacacacatacacacagcatagttcatagtcacttgatttgccacctgcagtttataatagaatggacctgtgggattataaaccactttatttctgcacagaatttctcagcttgaggccaaattgaagggcattagtcatcagtaatttgcagatgtttttaatgtttttcacccaagagaggtttcaggcagctaaagctaagataaatttcctcatgctttggtggggaaatgaaaaatctgatcatttagttaatcatttgtaagagctgtgggtatgtattgttccttagtgactgcaatatcatgacagatttgttaatttggtaacatgacaatgtaaacaatagtagataaattccattatgccatgattcttttcttcctctcagtaattttgtatattcaaggtttaaaatccatagaacattagagatggaacttagagatcaacctagagatcattggattcctctaccaagctctgtcaaatgccagtcctgagtgtctcccctggagcatcaggataaatagctaatgcatggggggcttaataggtgcagccaacccaccatagcacatgtttatctgtgtaacaaacctgcacgtcctgcacatgtaacctggaacttaaaataaaataaaatttaaagaaaggaaaagagtacataatcagtggaaccataaaggtcagttctagtgggaaaattaggaaaggcctcctagaagagaagacatttgagctatacttgaacaggccctatctagcagcatccagataggtggtttgtgaagaagccagttcctactcttacgtctttaccatggttatggtttgaatgtcccctccaaagatcatgttgaaatttaattgccattgtgagaagaaatgggacctttaagaggtgactaggtcatgagggctctgcccttatgaatggattaatgctgttattgtgggagacggctcctagtaaaaggataggttcagtctcctttttctctctcttgagctctcactctcttgccctgtctcactatgtgagaccttccaccatgttatgatgcagcaagaaggccctcaccagatgtggccccttgatcttggacttcccagcctccagaaccatgagccaaataaacttctattgtttataaatgatgcagtctgtggtattctgttacagcagcagaaaatggactaacacaactattatgcacttgcttatgtattggtttggaattattctctaatttactcacgcttgtatggtatgtgtttccttattctgtgtatctctgggtgttatatttaatatttgtacagatttcctctgacatttcacagttcaggtttccgatttcttctttctaaaatctattctctagatttgaaagcattctatgatttgtgattcatatataccatactataacatctagaaaaaatattctgaatagcatactgagcaatggaaatcttcatcatgaattttctaatgagtataaaatgttgctgggcaagtttctatttaaatcatgctcgctaggcttgactaactgcagacattcacagggtgcatgctgcagagtgctttactttcaacaaggtaaggctgtacctccgttagggactaattcagggtattcaacaagggatcagactagaccaatttggggttgttaaggaactaaaactagctcacgagaaactcaaatcagctcatgaaaagaggggctgcttggaagaatgcagtaggaaatttcatgggttacaaggacagacagcaaagcttagcaggcctcagagggccaagatgtagaattcacagtgaacccactcactaatcctctttgtctcactctctcaagcatggtcctttcagtttcttatttctctgttttctttttcttctcaggatgagcctctgtttcatatggtttctgctatcctctgacttcagcacacatttgggtcataatagtctcctctgtagagatctcttatatgtttttttaaaaaatatttattttaaaaagtagaataacatatgcactagcaaaaaacatgactaaaaatgtgtaataattttaaaaagcatataaatttctctcttttccaaactctctgatttttaccacctctccctaaagtttaagagtttcctgtgtagccttctggaaaaatgtatataaggatatacacatacatagagacatacacacaaatatacacataaaatgactagaaatgcaaatattctttgtatttacacaaaaattgtcctctctatacactattcaacacttttaaaacaaatcttaattgtatatttggcattctttccatattaattggcagaaaatttaccttttttctttttggtggttacctgtggctacattgtatttaattttatgtaactattatgatttattagataatctctccatgatgatgggcctctaggttgtatctggttttctactgaaaataatactatagtgaacaatcttgtatgtctatctacttcaagtttaatagagttttagctcttacatctgtttaatgattaaagttaatttttatatgtggtgtaaggataaagattctttttttctttttgcatattgctctacaattgttttagcactgttgaaaagttttcctttctagtatgtagaaatataattgaatttaaaatattgaccttgtttgtatcctgtaattctgataaactcactaattagttctagtaatgtttttataaattccatcagttttttaaatagataatcatgtaatcttcaaattaagcccattttacttcttcccttctaatctggatttttaaattttctttttcttgacttattattctggcttcaccacagtattcaatataaatgatgagagcagacatccttggcttctgatcttaaggtgaaagcattcggtttttcaccattaagtgtggtgttaacttcaggtttttcctagattcctgtatcagatgaagaagttcctttcactttctagtctgttgagagatttttgttgttgtttttaaattttgaataaatgttgaattttttgtgaatgctttttctgcatcgatcgagatgatggtttttcttttatgttctgttaatataaatctaagtgtgctttttttgattatatatgtaaagtaaatgcctaccagtagaattacagagacaaagggaatgggcatttggtagattttgactaataattcctcacaaagattgtttacgctttcgctcatgttgtctcagagtgcttatttctcttaacactattatcaaacttctaaaaatcttgacagtgtgataggagacaaatggtatctcattagtttgatttgccgtttaaaatttactagtgagatttagcatcttttatacatttaaattttttgagtctttttcttttttattgtatatactcttgatagaaaattagctcctgatacaaaccttcttttctatttattttttggaaaaatgttagtacttacaacaattcttttggttgtagagacctttttacttgtatgcaattatgtttatcaatttttttcttagggcttgtgagttttctattctacttgaaaatatttcttgcctacaccaagactataatgtatttagctatatttttttaaaaaattttgagccaccatactctattttggagaaaggaatgaggtagcaatctggcttaactttttttctgaacagccagcaagttaagccagcataatttattgaacagtattatttagtccatcttttgcctattgatttgtaatgtgatttttatcataaaccctatttctttgtgtatttgagtctacttttggtttctagtctaacgatctgactacttatttctacccctgtggcataatgttttaattactctagcagtataacatgttttagtgtctggtcaaattatgttcactaattattcttttttaaaattttcatgttatgtgtttttctttttctgtttctttttttttttttttgagactgagtttcactccattgcccaaggtggagtgcagtggcgtgatctcagctgtctgcaacctacgcctcccaggtttatgttattctcctgcctcagcctcctgagtagctgggattacaggcacctgcaccacacccggctaagttttctgtttttagtagagacgaggtttcaccatgttggcctggctggtcaaactcctgacctcaagtgatctgtctgccttggcctcccaaagtgctgggattacaggtgtgagccactgtgaccagccctcatgtgtttaattttctaatgaagtttaatatcattttgtcaaattcttaaaaaaaaacaaagcggctgggcgctgtggctcatgcctgtaatctaggactttgggaggccaaggcgggtggattgcctgagctcaggagttcaagaccagcctgggcaacactgtgaaaccccgtctctactaaaatacaaaaaaattagctgggcgtggtggcatgcacctgtaatcccagttacttgggaggctcaggcaagaaaattgcttgaacctgggaggcagaggttgcagtgagctgagatcacaccattgcactccagcctgggccacagagcaagactctgtctcaaaaaaaaacaattatttactttcagactaaatttaggaagaattgacatcttcacagtaaggttttctatccaagcataaggtatatggttttgcatttttttggtctcttttcatttaatccattgattttaagattttacttttatacattctgctctgttctcgttaggtttagctttgggcattttactctctttaattcctattaaaatgctattttctttctggctgattacttttaacatatagaaaaatatattttgaaattgcttgatttctagatgctaattttatactcagctcctcaatgaatcaacttaatttttttcattgttaaactttgattttccaggaataaatcattccactatttattttatattcaccatcttcccagtgtttatttctatgtttttttgtctaatcacagtggctaatacttcaaaaacaatgcaaaattttatagtgtttgtgagagatacttgtcttttttcttgatttttattagcaatggttgtagaaatccattattaactaagatgttgacttttggtttgagagatatgtttctgtgctgtttaaatgctagaaaggaattaacccatttgaattttttaatgttctaaaaattagatattaaaacttaccagattcattttggatttccatttttaatggtgtttcatactttgatatattaatgggaaaatcatagtaatatattccctaatgttgcattatctttgctaaattctaatagctgattttttttctgtggttttatgtttgtttatttttaatttttagtttttgtgggtacataatagatgtatatatttctggggtacatgagattttgatacaggcatataatgcataagaatcacatcaggttaaatggggtatccatcacctcaagtatttatcatttctttgtattacaatctaattatacttttagttatttttaaatttacaataaattagtgttgattgtagtcatccctttgtgctatcaaatactagatcatattcattctatttttttgtacccattaaccatccctactccccatcaccactacccttcccagcctctggtaactatccttctactctgtctccatgagttcaattgttttaatatttagctttcacaagtaagtgagaacatgcaaagtttgtctttttgtgcctggcttatttcacctaacataattacctccagtttcatccatgttgttgcaaatgacaggatctcattctttttatggctgaataatattccattgtatatataaacctgattttatttttccatttatctgctgatgaacacttaggttgcttgcaaatcttggctattgtgaatagtgctacaataaacatgggagtgcagatagttcttcaatatactgataacatttcctttggggtgtacctagcagtgggattgctgaatcatatggtagttttatttttagttttttgaagaacctccatactgttctccatagtgattgtgttaatttatattcccaccaacagtgtacaagagtctacttttctccacattctcaccagccatttgttattgcttagtttttttggttaaaagccattttaactggggtgagatgatatctgattgtaattttgatttacatttctctgattattgattttgagcaccttttcataaacctatttgccatttttgagaaatatctgtttaggtcatttgttcattttaaaatcagattattagatttttcttatagagttgtttgatctccttatatattctcattattaataacttgtcagatggatagtttgcaaatattttctctcattctgtgggttgtctcctcactttgtttattgtttcctttgctgttcagaagttttaaacttgatgtaatcccatttgtccatgtttgctgtggctgcctgtgcctgtagggtatcactcaagaaatcattgcccagaccaacgtcctggagagtttctccattgttttctttgagtagtttcatagtttgaggtcttagacttaagtctttaatccatttagattttatttcattcatttgcatatggataaccaattttcccagcaccatttattgaggagcctgtcctttcctcaatgtatgtttgtggcagctttgtcaaataagagttcactgtgaatgcattgatttgtttctgtgttctctattctgtcctattggtctatataactgtttttatgccagtgccatgctgttttggttactatagctctgtagtataatttgaagttaggtaaagtgattcttctagttttgtttgctttgctcaggatagctttggctattctgggtcttttgtggctccatatacattttatgatgttttttctatttatgtgaggaatgacattggtattttgatagggaatgcattgaatctgtagattgctttgggtagtatggacgttttaacaatattgcttctttcaaactatgaacatagaatatctttcccttttcatgtgtgtcctgttcaatttctttcatcagtgttttatagttttcgttgtagagatctttcatttttttgggttaattcctaggtattttatttgtagctattgcaaatgggattactttcttgatttctttttccagttgtttgctattggaatatagaaatgctaccgatttttgtatgttgattttgtatcctgaaactttactgaatttatcagttctagtagttttttaatagtgttttggtttttccaaatataagatcataccatctacaaacaaggctaatttgacttcttcctttccaatttggatgccttttatttctctctcttgtctgattgctttagcaaggacttccaggactatgctgagtaacagtggtgaaagtgggcatccttgtcatattccagatattagtggaaaggctttcaatgtttccccattcagtatgtgggtctgtcatatgcaacttttattgtattggggtatgttccttctatacccagttttttttagggtttttatcatgaagtgatgttgagttttatcaaatgctttttcagcatgaactgaaatgatcatatgatttttgtccttcattctgttgatatgatgtatcacattgattgatttgcatatgttgaaccatacttgcattcctgggataaatcccacttggtcaggatgaataatctttttaatgtattgttgaatttggtttgctaatattttgttgaagagttttacttctacattcatcaggaatattagcctgtagtttcctttttttgatgtgcctttgtcaggttttggtatcaggctaataccggccccataaaatgagtttgaaagtattccctcctcctctatttttcagaatagcttgagtaggattggcattagttcttctttaaatgtttagtaaaattcagcagtgaagccatcaggttccaggattttctttgttgggagacatttttatggctttgatctctttatttgttactggtctatttagtttttggatttcttcatggttcaatcttggtaggttgtatatgtctaggaacttacccatttattctagatttttccaatttattgatatatagttactcatagtagccactaatgatcatttggatttctgtggtatcagttgtaatgtctccttttcatctctgattatatttatttgagttgtctttttttttttttaagtctggctaaaggtttgtcaattttatttatcttttcaaaaaacaaaaaggtttgtcaattttatttatcttttcaaaaaacaaactgtttgtttccttgactttggtgttgttttcttcatttcaattttacttctttctgctctgatctttattatttcttttcttatagtaattttggttttggtttgctcttgcttttctagttcttttttttgttttgtttttttcagatggagtcttgctctgtttcccagcctgtagtgcagtgacacagtcttggctcactgtaacctctgcctcctgggttcaagtgattctcctgcctcagcctcctgagtagctgggattacaggtgtgtgccagcatacctggctaatttctgtattttagtagagatgaggtttcaccatgttggccaggctggtctcaaactcttgacctcaagtgacctgcctgcttcatcccaaagtgctgggattacaggtgtgagccactgtgcccagccacttttctagttctttaacatgcatcattaagttgtttatttgaagtttttctacttttttgtatgtaggcacttatagctataaccattcctcttagcactgctttcactgtatcgtgtaggttttggtatgtagtgtttctattatcatttgatacaatacacttttatgtttccttcttaatttcttcattgacccactggtgattcaggaacatattgtttaatttccatgtgtttgtacagtttccaaaattcctattgttactgatttctagttttaatccgtcatggttggagaagatacttgatataatttcaattcttttgaattttttaagactaatttggtggcataacatatgatctatccttgggagtgatatatgtgctggggaaaatgtgtattctgcagccattgtatgaaatgttctgtaactatctaataggtccatttggtctgtaatgcagataaagtccaatgtttctttgttgattttctgtctggatgatctgttcgatgcttaaagtgaggtgttgaagtctctagctattaatttattggagcctctctttagctctaaaatttacatatcagagtgcttcagtgttaggtgcatatatttacatttgttatattgtcttcctgaattaacccctttgtcattatataatgaccttctttgtctctttgtatagtttttgtcttgaaatctattttgtctaatgtaagtatagctacctctgctcttttttggcttccatttgcatagaatattttttttccatccaaatagaatcccaaagtagttatattcagtccgtgtgtgccttgataagtgaagtaggtttcttgtaggcagcagatcattaggtcattaaaaaatctatttagccattctgtcttttgattggagagtttagttcatttatattcaatattattgataaggacttaattctgccattttgtcatttgttatattttctgattgtgtttgtggttatctcttctttctttcctttttttctttttagtgaaggtgattttctctaggtatgttttgattacttgctttttatttgttgtgtatctgttatgttttttgatttgcagttaccatgaggcttgcaaataatagcttataatccattattttattaataaactaatgataactgatttcataagcaaacaggcaaagagaaattaatgagaactctacactttaacttcatctccctgcttttttggctgttcatatcttattgtactgtctatgtcttgaaaagttgctgtagttattacttttgatcagttcatcttttagtctttctagatatgtatagtttacacaccacaattagtgttataatattctgtgtttttctgtgtgcttactattgccagtgagttttgtaccttcaaataatttattcttgctttttgacatcctttttttcagattgaagaactccctttagcatttattggaggtcaggtctggtgctgatcaaatccctcagcttttgtttgtctgggaaagtctttatttttccttcctgtttgaaggatattttggatggatatactactctaggataaaagtttttttccttcagcaatttaaatatgccgtgtcactgaggagtctgctgccagatgatgactggagctctttgtatgtaatttgtcatttctcctgctgcttgtaggatcttttctttatttttcaccttttgcagtttgattactaaatgtcttaaggtggttttctttgggttaaatcagcttggtgttctataatcttcttgtacttgaatattgatatctttctctaggtttaggaggttctctgttatcatccctttgaataaacattctacccctttctctctttctaccttctctttaaggccattaactcttagatttgcccttttgaggctactttctagatcttataagtgtgagttcttttttttatttttcatttttcttttgtctactctgactttatattttcaaatagcctgtcttcaagctcactcattctttcttctgcttgatcaattctgctgttgagactctgatgcattctttagcatgtcagttgaatttttccatgccagaatgtctgcttgattgttttaaattatttcaatctctattaaatttatctgataggattctgaattccttctctgtgttatcttcaattttgttgagtttcctcaaagcagctattttgaattctctgcctgaaaggtcagatatttctgtctccccaggattggtccctggtaccttatttagtttgtttggttaggtcatgttttcctggatggtcttgacatttgtggatgtttctttgtggctaggcattaaagagttaggtatttactgtgttcttcacagtctgggcttgtttgtacttgtctttttaggaaggctttccaggtattcaaagggacatgagtgttgtgatctaagtttttggtcacagcagcaatatctgcatcaggggacaccccaagcccagtaacactgtggttcttgcagactcatataggtaccaccatggtggtcttagataagatctggaggaattctctggattgccaggtagagattcctgttctctttccttactttctcccaaacaaacagagtctctgtctctctctttcctgagctgcctagaactgggagaggggtgacagaagtacccctatggccaccaccattgagactatgtggagtcagacctgaagccagcacagtactggctcttgtccaaggcctgcagtaaccactgcctggctactgcctacatttactcaaggccctagggctctgcagtcagcaggtgatgaagccagctaggtttgtgtccttcccctgtagggcagcaagatccccctggtcctacatgggctcagtgatgatgtctggaagccagggcctgagtcagaaaccttagggatgtacctggtgctctattatactgaggctgagctggcacccaagccacaagacaaagtccttcccactcttccctcccctttgcatagcagaggagtctccctgtggccaccacccaggccatagtaagaactgcctgactacagccaatgttcattcaaggcccaaatgctcttcagtcagcttatgatgaatgctgccaggcctgggactctcccttcagggtagtaggcttccccaacccctggcccaggacaggtccagaaatgccatccaagagccaaggcctagaactgaggaccctaagagcccacttggtgctctaccctactgtggctgagctgctgcctaagctgcaagacaaagtgtcctttactcttttctctccttttctcaagcaggagtccctccccattgctaccacagttaggtaggtcacacctgaggccagcatgtctttgaatcttacccaaggcccgctgcaaatactgcctgggtaccaccgctgaatattcagggcccaagtgctcttattagcaagtgatgaatcctgtcaggactgggtccttccctttaaggcagcaggtttccttctggcccagggtgtgtctagaaatgtcgtagaggagatagggcctcaggactcttcctggtaccctgtcctaccgtggctgagctggtatccaagttgcaagacaaagtcctctttactcttccctctcctctcctcaagcagaaggaaagagtctcttctggagctgtgcgctgcactgcctggggttggaagaggggtggcacaaatactcccttggctctggctgatgtgttactaggttgcatacccatcaagtccactggctttgagcccagcacagcgtcaggacttgcccaggaattgcagtctttgtggcctagactacctttcagatttctttagaaccccagagcaatttagttcacggtggtgaggcttgccagaactcaagttcctatcactgggaggtgcaatttccccccggctaggttgttctaaatgcttcctccgtggatgctggctgagttctgcctggtgttactttctactgtgacagggcagtactgagttccaatgcaaagttccccaatcactgtgctctccctcccgcaagtgcacagattatctccgtgccacatgactgtggctgggagattgggggaagggtggcatcagcaattcaagattgtctgtcctaccctcttcagtgtctctttcagtaatatgaagttaaaaccagatattgttatcactcatctgattttaggttcttatgaaggtgcttttttgtgtggatagtttttcagtttggtgttcctatagggaggactatcagtggaagcttctgtttggtcatattgctctgcctgtaactcgagattctcctattggctgatttttaatttagtatttttatacaggtattccgaagtgaggttgattgcagttttatttttctgtgctacttttatcatgtttttgtaggaatattttgttattttactctaagtgatttgaagtttttttcttcatgacctggaaaccataaatagcattggaattatctttttctttcttcatgacctggaaaacataaatagcattggaattatctattctttgaaggtctggaagaatttattgttaaaaccatctgagcctgtggctttttgagggctagctctttttttttattattctgaatttcttccattatatgtctacttaagttttctatttcttttgggttcaattttttttatttgtatttatctaagaaagcattcattttataattatttataattacaaaaaatatttacttatttagcgattttcaaagtagtcatataatttttgaatttcttatgcatctttttcttttctatttttatttgtgttttcctctttttcttgattaatctattttatctattttattgttttgtccccagagaacaacatctttaatttaattatatattctactgtttttctgttttctaactcatcaatttctgcttttattttttcttctactttccttatgcttattttatttatctatttctacctttttgaatagaatattaaaaaaaatttctttttaattataatttgcttggtaaaacgtttaattctataacattttgtttttcagcccagcttcttaagttttttgcttgatagtatcctcaatatttttatttttatatactctgtaatttcagttttaactttttgttttatatcaagacctaaaagagttttaatattctcaggtggctaggtttcttctttctattattaatatttagttttattgtagtgtggtcagggaagatttttcaaatttcattttcttggaatgtattgaggctttactttgtggcttaatgtattccttatttttaaaattaaaatatctcattagtgcttgaaaataagttttatgttaaatatgcacttattgatgtgcatctaataggttaatctttttattgtatcatatatttcttattgtcaccttgttctgtcatagctgacaatgtcttttactattattgtgttttgtctatttcttctataagtttatgcttttatgaattttgacatattgtttttgatactgaaggatttatgacttttataagcttattattgatttaaagtctgcccattctaacagtatatagaatagtatctggtgcctagtaattgctcaattactattgttgaatgtaaaataaccctttatgttctttgatagtttttaactttactcttttctgatattaatattatgattctttttggttttgttatcatttacctggtttatctttgacttcttttttttacttttaaagtttctgagttatagactcttgaacagtttgttttagatgtggatatctatagatctgttttttctatgttttgaccttattaaagaatcttaattgatacaacagatatttacctctgtttttaatgtccccctcaccaccacctccactcgtcctctcttactccacagattgtctttttgttgtttgatgtttgtatgtgtgttcatatgagtaagtgtgctttttttgttgttatgtcaaagacttatagtctatttttaggtcttttagagatttgataactttatagtgtttttagcatccatttagcaatttatcaattatctattgcctacttactgaaattagtgagaaaattaacatacatattttctccttattaatattgtctttttgcttggttaccttaattttaaagaggatatttaaatctcagtttcttaatttagcatcaaaaaataaagaaaaatgaggaattttcacccttatttttctgtttaatttgattatttacttttatttttgaaatgtataacatttcccttttgtaaacatacttcacactgttgattagctttatttctaagtataaatgggttcagttcttcttatcagactttttactagggcttcacatttatctcttggttagctggattttggaatcatgtgactttttcaggaaggactcaagctgttgcatgtctgaaagtgtctgttgttgtctttatacttcaacaacagtttggttaaatataaaaatatttgctcatactttttttcccttcgaaactttgtacattctggacatggtggctcatgcctgtcatcgcatcactttgagaggccagggtgggaggatcacttgagcccaggagttcaagaccagcctgggctgttaggaagatcctgtctttacaaaaaataaaaatatttagccaggtgtggtagtgtgcacctgtggtcccatctactccagaggctgaggtgggaggattgcttgagcctgggaggttgaggctgcagtgagccatgattgtgccactgcactccagcctagacaacagaggaagaccctgtctcaagaaaaaaaaaaaaagagctttgttaatatacatggtttacatatttttctggttttgaatgttaactggagagaaacctgagcttttgttttatttgcttttatttggttttggttttgtgtgtgtgtgtgcatcctattgtattagtcagggttctctagagggacagaactaataggatatacgtatatatgaaagggagcttattaaggagaattgactcacatgatgacaaggtaaagccatctgcaagttgaggagcaaggaagtcagtggtagatcagtccaagtcccaaaacctcaaaagtagggaagctgacagtgcagccttctgtctgtggccaaaggcctgagagtccctggcaaaccactggtctaagtccaagagtccaaaagctgaagaacttggagtctgatgtttgagggtaggaagcatccagcacaacagaaagatgaagtccagaagactcagcaagtctagcccttccgcgttcttctgcttgctttatcctagccgctctggcaactgattagatggtcccacctagattgagtgtgggtctgcctctcccagtccactaactcaaatgttaatctccttttgcaacaccctcacagacacctccagtgatatgggcaggagacagggaaacactaggtagaagagggcagtcacctggcaaagaccccacccacaggcatggaaacccatggctccagtgggaagaggcattctgttttcatgcccaaaagttggcttttggcatgccacaccgtcctatcctgtacccatataaacctcaaaccccaggctccacagaagatgagaagaacagaagaacggcagaacggcacagcagagagaagagaaggagcatctgaatgccaagaggaattcagcttggggtggttggagaagagatctgccactggacagccaagcttcaggggaagatcatcttcccaccccatccccatccatcccactgagagccacctccaccactcagtaaaatccccgcattcaccatcctcaagtctgtgtgacctgattcttcctggacactggacaaggacctaggtaccgagggcactgagcttgttaacacttaagccgtctgtggacagcaaatctaaaagaatgcactgtaacacatgcccacttgggctttgggagttttaggtacccacctctagatgctagcatgagtctggagcccccaaggcgctcaccccagatcctgcacctgcctgtctatgtgctccccctcccataaggagtttgagcagacacacagccaaacagtcaagccacacccctgcagcatgtcctatgagaggggtcagggaactctgccatttcaccaggaacaataatttggatcttttaatccaagcaagttgacactcaatattaaccatcacacatatacctaaaaatttgtttctctaccttgatgttcagtaattttaacagaaatatttgtttttctgagagttgttcatttttccctcagatttgtgggtttctgagtgttaggggcagccacaattgatggatatgagctttactcttctttctgaaatgtcatttaatgtgcatattagggtcattccacctgataggaggcaactcctacagcatagctttggaaatgttcctcattttagaatagagcctgattatttctcctacttccttttaagagcctagtattggccagatgtggtggctcatgtctgtaatcctagcactttgggaagctgagtcaggaggatcactgtagcccaggagtttgagactagcgtgggcaacacggcaagaccctgtctttactctccaccccaccaaaaaaattagctgggtgtggtagcacatgcttgtggtcccatctattaatacttgggaggctgagatatgattgcttgagcccaggaggttgaggctacagggggtggtgatcacaccactgcactacagcctgggtgacagagtgagagcctgtctcaaaaaagcctagtgttgagtaatacatgtaaaaagttcttaataaatccttactgaatgtataagtgaatgaacctagactcattttctgctgctgtctttccttctctgtccatttttctctaagtaaagatgaaactgcctttgcaaaaattatatcagtgagaaaattatggcagtggggaagatttgatctagctaacccctctagtgctgttagccttcaagctgccttcagttattcctgggttaactttaggagacatttagtttatagtttaaatgataatagcccttccccaaaactcagctgcctttgcaaagctaatgagagagcaccaggctaggagaaggagaggagcctgaattctgctaaggtgtagatatacctgattggtagccattgtttcagaggtcacaagacatgcaacttccccaattactcctgcagataacatcactatttttgaacctaggatcggtcttttgagatatcttttcaggtttttttttttttttaaacatgtctgacacctggctccacctggatggccaacttctcctgtggccccacccagcagcaactcagagcaagaggacagcttcaactccctgtgattttatctctgacccaaccaatcagcagcaagtgcccagtgcctcgccactcccacccgtttcttcaaactgcctttgaaaaacccctaaccttcaagctttcaaggagattgatttgagtaataactccatctcccacatggtgtggccagcctcatttcaaactttctttactgcaatgccatgaattgattttgtttgtgcagtaggcaggaagaacccatcaggcagttacagggaatgttgctgagatttttcaatattttgttccttcaccatttggcaaatcccatcacactctgggagaagagagtgaactgcttgagcagtgattcttgggatcttctctcattttcactgaatgctactcttcaaagattatggcgtgaagttatatcccttcttttgtttgattattgctggtatattttgatttgtttgctggatttcaagtttccattttagtgttgttcattcattcagttttagggaaaggagatacttgacttcactttgccatctcaccccagaagtcataaaaatttttgaaacaaattcggaacctccagagcagagctcagtttcttcttcctcctcatatttcttgtagaatctagtgtagcttgaatgggattggaatttattaactatttactgaatgcataaataacattttatggtaattttggctaatttatgacctgttattgaaagaagggtagatggtgtacaatcaccttgaaaaaagtatcatttctgattaatcttaagaggggatgggcaaagcagcaaggaatgtgcagtaagacatgggcgaatcagccacacgtcagactgagcatgtttagtgctcactgcaaccctgaagaattgagtccatctattgcttttgacctaatgtgggaaataagctcctagggcctctgaaaagatatgggtgaatgatcagaaatttatcaggagcacctttctcctttgggttttttttttttttttttcccttcttcactaaacacatcagttttaagggcaccatgtgaaatttcatttttgattcctttcattgctaacgtcaaggcccactttacactattcttcattttccctccaggcctttcactggctgcttaagggcagtccacccagctagttaatgcgtatttctctcttcttttatgtgactctgtttacacttgggcagacatagcttcctgccaatgggcagtttcttttcagggacaagatgagaaagatcacagagctttgtagtgatgagtggttttgttcatctcagtttctgcatgttgatattctttctgttttcctccttcaggaggaaggaacaagaattggactagaagaagaaagtcatttgtattcttctgactattgattttccttctaccattcagcagttcagtagttttgcgtaactacagctgtttgggctgggacatcagccatattgtgggactgactatatttcagtaagcaagaagtagattgggaaggtgaatttctgacaatatgagtgtgggtgctttaaatttacttcttttcactcaagttatctaacatagagcgaggataaaaaagaagaaatatgagtcaaatgcctggtagtacactgatgttggggattagctcccagtgtctatcagggagccctcatgaaggttaccataacctagggacaaagatgttagacttaacagttttcagccactttccctggcagcagccaccattcagcagcctatcaagacaactgtccaatcatgaccagaacatcctctttggctgttttactctctcctgtggtgtgtacataatttccatttttagaatcatgtttttaggatgtttcagagccatgttactcctccactctatcttttattaccatttcttaaggagggtccaagttctttttcaaaaaatttatttacaatagaggaagaaaataaaaagtaacatgaggttgctggttaagaaataaaaatctttttgtttcaaaagtccactgcccccagttctgtgatctgttgcacataacaaatttttcccccaaccaggaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgtaagtaacagttgtaaattataaccagaatttggtgttttatgcacactgagttttcaacttcttttcttgattttaggtttaattttcatgaaacctggtatgaaatctcaaaatgggtcatgatttgtcagcttctctgaatgaagggactccacttggagttaaagcttcccttgacttttgtttcttgtccattttactgttgtgttggtttgggaccactgggatcttcaaaagttattctcttggaaagagtaatatattttactacctggtctttctgtaagttacaaagtgacccagacttgtgatattcaatcatcttacgctgacatcttattttagagcaccggggttataatgctgtatgctgttttgcacagtgaggttttacatgtcctatcctgtgataggtcccttcaagcaagttctccataactgctttgaaaattcagacacttttcaataaaaaagatatttatgatagtattattaaagaaaaaatatcataaacattattgatataattatgtaataatagaaggtgtaggttgtaatattagaatgtaataatgtaatactagaaggtgtagattgatatctgaatgtccattgttagatattttgaaggtatggtaatgagattgaaaatacatagtacatatgttttactaagtacttgagcatgatgtcatatctgtacccttccttacacattagatttaatccagcttgcatttttctaccctgtttaggatatggatgaagaaattgaggcagaatacaacattttgcagttccttcctaatcatcccaatgttgtaaagttttatgggatgttttacaaagcggatcactgtgtagggggacagctgtggctggtcctggaggtaagaggctcccattgggtaaccagtgatttgaacagagtgccagaggccaacagatgctttattacctagagggtgttttaaggtacacatttgaggagtaggtccctcctgcatgtcacaggtacctcaccagatgtgacattctcctccacagttcttacaggtaggccttatgctaaaaatatttttgtttctctgcttcagaggtttaataatcttttattctagtacagggtgaatataggaatataattgaaaacattaattttcttccctaacatttaattgtaaacatgtttgaattgattgcaactcattttcaaaaattgttaacccaaggtttacttggcttgccaagtttggatttgcccactcatgttcattagtcctcattttagattgggtttcctgaaaactgactctgagaattgtgtatggaaagtttgttgcagagttcttagcggaggtagacctagaaaaaagtgaggaaggcaggatcaggcaagggagacactgaacagcaatatggtcataacagagacctaagctggtcctctgggaaatggagagctgggcagtttttggaatgttgtcctgaattgtatctccacatcagccaatcattgcctgcatgccatccctgcgaaggagcgtgactttgggggagtcagttctctgaagtggaagccaacttgggtgaggggtgcagctgagggctgggagctgttcctgtttctagcagcatccactgtgaagagggaatctgaagggaacaacactgtatccactatagtcctgcatttttttctccaacaatccttccatacacaattctcagagtcagttttcagttattaatgggaatgaatgtgtgcatctgggtgcaaaagagtcaattccgaacaaatacgattccctatgaggctaaaatgacaaggaaaataatgacagtatatgaattaatatattaggacaggtctatcgccacattctcactaggcctacactgttttattctgggctctgaccttctgaaccagctcatgtctccatgtctgaggtcacgtaggtgacccagcacagtgtggacacaagtggaagccttaagagagaagcaccaggggagaaaccagccctcacttcactgtctggtacctcttgtccacatgtttctggctctgggagggcctgagcctgggacaataagtactggctgccatggcaaccatgtttggggaattcatttgttatattcaaatgggataatctgcagggaaactggtttgaatttatttctgtcacatcagttgccttcctcagaatatataagatgtaagggattttggttttctaattatctttgttcctttagttgactggttaagtcatataacacacttctttggggttttattaactcccccacccccaccccaagaatattaggattttatcttgccaatgaagctgtttaacaatgctatttggaaatgataaagtactgttcctggggtctctgattatatttgtcttcagctctgtaagatctctgtgttttaaacctcgttgtaacttagtaatggaagtacagtgaccaagaaacctcagtttctgcttatttttaactcctgactaaaaaaggctcatatcagacatagagaactgaaactttcaggaattttcgagggcctaaaaaggagccttccctccatgcaaccaggcaggcaggtgggctgctcatacctgaggccacctggtgaatgaacatccttcctgatgaggagtgaccctcagacatggcaactcaggtatggccaaagcagccaggaagtagcacatggacttgaaagatgagaaagagcccagaactatgagctgagccttgcgcaggtgctcccttgccacctgtttctagctttttcagggtgaccacagtaatgaagctgccctgagacactgaattattcatacctctgcaatacaatatgctgtcatttatgacttttgctggttgttttggtccatgccaaagtgggtgatatgagatactgggtgtcctcagtcttttctgtcccaggatgggcagtctaaaccaggctgctacatggtcatgtgcattcagtgcctccaatagtcttagggaaacacaggaattcctagactcctaatactggcagaagcctctctcttcagtcccctagccttcagatgagggacagaggcccacagaagtgagtaacatgcctatggtcacataattggttgtatggcagaactggaaggaaaagcatatttcagcacattttctttcaccatgtgcagctgctcctctgatgttatccattgggtcatggaaacacagatgtgaagtctctcactgggatcgtagcacttcctgaccacacacacagagctggatgacaatgatggtccacatagtaccctattttgttctctctgcagctttttaaggcatgctttaggggactcacacaaaaaaattatctgtttaatactgttctcctcatcttgcatattaagaataaatttatgttgcctttgctctttatttgcctgactgatgaaaggacgagtgagaagctattccacagagcaattctagaggatagaaaaatgttattaataatccccttaaatcacgacaactctgaaaacaaagcaaataaaaatgtcattttctgaaattcattactaattgttagtagaaagcaaacaaaagctctctttcatgatacacacctactatattggaaagatatggagagaaaatacacacacataatagtgttttggaaaatctgtgaatgcattttaagtgaatattaaatttttaaaaatctataagtccgcctttcacctagatgatatacatattaataaattagacctttaagaaaaacatgatgctcagaaaaaatacctaacatgtggtagctaaagcatgaactatattttctttttccttttagtgtaaaatctttggcaggtagaaacttaatttctgcatgaatcaagtgttctacttaaaagaaatggtttggagtactggtaaatgaggctggaaagtaaaacaaacaactttgtcctttaaaccatgtatgagaattagttttacatcttttttttcccttcagagatctcggtataagttcagtatctaatatgtagagccaaagcaaaagggggcggcgggggggggagggagggagggagaaagagagacagcagacagagagaccgacagaccgatggacctttgtccagattttgcttttatccaaggccctagaaagtataatctagacctgaatatcactggaagtgttacacatcaaaccattttgttgatactgtggcatgaattaagtttatcaggttaacaaatcagggtcttagtcatactctgacggactcaaatgtgggactggtggattttgattgaccagaagtggttagaaagtactgcagcattgaacactgactcagtgggttctagagtgagagacactggaatgctgggagcctggatgaaggcacagaaaacttgagactggagaagggaagaactttgaaatggaacagcattacatcccacaaacatatactatatgtgttcaacaaaagagagagagttaagaggctgaggactgggagtgattcttcccactcttggctctattcaataaggatgtgccccaggaagagaatgagatgggaggtcactctcagggcccacttccctctcattgtatgagcatctctccactctgatagaaactctagggtttcaagtgacatagttttcactggtcttgtggcaagccagtgacttttgctggctttcattaaaataaacatgattcgtccaacaccagaggaaaaaatgtgctgttctggaattactgagaggcggacagtgtccaacatgatacttcctaagggattttctgaagtaattttgactgtctttgacttttcctttatgttatctgtagaacccaacacccttaaaagacaaagtctactgaacaaaggggcaccaaaaagaaattcctcttaattctgcaaactgactatgtcaaagcagcaagctagtatagaagctacttgaacgttggagcctaggtctggtgattgtgttgcatgggccattctttaataatgtggaagaaagttgatggcttattgagcaaggaacattttattgcttgaaatgatgactgtcttagcaaatgcacatactgtgattgaatcaatattcaatgacgttttggaaaatagatgtggaatgtaaatgatttttctatttttcttggtttggagcaaaatgctcattaaattctagatgcattcagctaccacatttcctgaatgctgagggcgtagggaggaactgcaggaatgaaaacacacttctgtatttgaatctggtggctggcagagtgggcgggaataaagggctgatatgtcaaccctcagggctggggtgggaggcttggttgccttcttacaattctaaagggattattttacttggtgcatttaaatataattctttgttatgcttttaaaatgttcaacccatttcactgaacatttattctgattagacaattgtcagtgtacacctgatttcttttttttatatccaagtgcccagtcttttttctataacccataggctgcccttgaaaaccttgctggtgggcttatcaacttcacaggacagcttcctttaaaagtgtcctgagcagtttaattatatgtttctgtgagttctgggaagtcagacagctcttatactctgacatttagtgaacaaaaagcactggctgggtaagattcctttgttgtttttaaatccatagctgagttttgatcctgctgacaaatagctactcttaatcccttcataagttctagagttacaaataaagtttataagttggctacctatataaaatattgctgaagaggcctttgttgcaaaaatggccacacttaaagtagggcagggagagagaccaaaatgaggtgtcaggggaaaattccagggttgcattttctgggatcatcacccagcatttaatttaaaatttctctcagtagaattttaatagcatgcttgcaatgcaagaaagcctgtgcctccctgagatgtgagccagggtggggagtggtcctgatgaaggttctgttgtgctttgcatccctattactgcctttcctttagaggagcaaagactattgatattttcctaattctcacagtttccctagactctgtctcttcttcacctttcacatgtggctggtcagaaattcctgtcatttctatctcaaaaaaagtctcccaaatctctccctcccttttatcctcatgacttcttgaccctgcctctcttgattacgtcaatatcttccaatggatactccagctcctagtgttgtcttctgtccatcctccatctgctgaccaaatcatttttctagaatgccagtctgaacattgagacctcctgcctaaaatctgttaatagtttcccttttttatctagtgatatatcatggtattataatatacatagaatattatatgggtagtatacaggtatatattatatgcgtagtatatggatatatattatatgggtagtatacatagtatattataataaagcccatactccttagcagggcatacctgtcattccctgtcattggccttcctcctccatctccctgccccaggattctggcatcctttgtcccaacagtagtagagtatttagaactcatcacacacatgtaccctcacatgcacattccccctcattctttcatgccccctacatttgcacaagatgtccccatgttccttttcacagaatcttctttcccttcatgtccacctgccccaaacccatttgtccttcaaactcattgtaaatgttacatcctctgggaagttttcctagactgtcccctctttgccctccctcagcagagttcacccttccttctttggtgccaccacacttccttaggcacagctctgcttccacattccacactataattactcgtatgtccattactgggcagtgacctctttgaggctagagattgtgtcatattcatgattgagtaataggtaataaaccagacagtcataaactattgataacaaagaggtgcctttcttctcaataactgaactaaactgggttcttgagcccccagcctgactaaaggaggcaactgattctaacccattttgttaaacttaagtccagttgagtgactttgtggagtggcatattccagtatttatatccaattttcactgtccagttcaaggcttagtcatttgggtacgtactcagttttttagggcctcttctctccctcttccctctcccttttccctgggtggcatctggatctgggtacaagtagatgcttacataatgccatggtagtgagggcagaggcttcggaactgtattgtaaccacaaagtccttgtgataataaaactgtattttctccctttggtatctttgatgttcctggtctctgacactccctcctatcatgaggtcctcatgtcctttgtccttatttaaactctaaccttatccctgtccccaaatagagcatgaagttctgagtgtcttacaagttgtgagcagattgtagaaaactgttattgtaatctcaagcatggtctacctcaccatgccatactttcatttcacttgacacagacaccccttgttatcaagaggtctcctcttagatttccaaatgggaagaggatcataagaaactgaaatttctattatcattacccgcttacacagacacccccctcccagagggagcatcctcattctaatcttgtcctcttaatctcccctaactccagttaggggaaaacagtcagatctccctcagaggcctatctaagggttgctggccaaaggggccatcatccgaggctccagttgcatgaccatttggagtttgatgtcatgaaggtgagaaagagacaaactgggttattagaaaacatgtattaaaacaaaatgggggcagggggtggggatagctcaaaagtcttgaggccttttatgtttgcacaggaagagggaggccaaaagcccaactggtaaaaaacttttacctttctgccatcgtgtcaggcttttgggttcccttcccctgagcgcaatcctaagccaaccagtctaaggtttgggaaattaactgttcctagtttggaggatgcatctgaggggagtgtcccatagtacagagagacaattacctatcagtgaagagaggaagagaaagaaaaaaaaaaaggcttttttttttctcaaaggattagtctaaagtgcatcccaggggttcaggatgcactcaaaaggggtacagactgaagatgaatggctactcatctagaaagaggagagcaaggcatccctggttcccttctcttcctagcaaatacctggggtacatgagggagagaaagtgagtcattcctctttcttttcctccatccttgtatccccaagttccagtgactgtgacagggtactgcccatggagtcaaagcggctttcacccttgttaaaagggagtctgggggtgggagtatccactcttacccacgtatgccctatctcctctgctgtcagtagcctttgaattctctagacctcatttatgccacgggtagtatcatgacctttatccatgaaatgggaagcctggcttaactggcaggaaaccagtcatgctcacctgtgctatgccttttaacttccattatcatctacctctggatccctcaaatccagttttctttcctagggctttgacctgaagcttggaattgagtttgggacaaaaatgtgcctcggagaaggggtgttgcatggactccttatcataagccaaatgctaaggtgaagctgtggaattgagtcctcctccaacaagggagagaaaaggatgtcttgtgacatgcccagataactggtggctatagttatgcttgctaagatgtaggtgcatggggcttggctttggttagctcccttggtcttactttccccagaagaaaactctgggtgatgggcaccctatttatatcctatttattcccatcacctggcagtatttgcaggataattgctcagaactagaattttgatccaggtttttacatcacctatcccttttattctttctaagctgcagctggagattcctggttggttcacaggaacaagcagggttagtctaaagggtaggcaaaaacttaaaaacaactaatgagtctagaatttaatgacaaatgtatggtaagttttaaaacataatttctctatctccagtccctcatttttttgttaaaaaaaaatcaggactgagttgctggcaaaatagactttagtcttacacttgacctgattatttgcataaagtgcagcaagaataattgtttctacataggccttttagattggctttgatggaactctgttcctcaaggaatttcggataagaccttttaaagctgagcacagccatgggtttgtatcctcaaatacctgtgagttgggtgatcctctccttttaaggtcccaagataaacttagagctcctggtcctgtcataaagtaacattttttacttactacaggtcaggaaccctatacaggtactgcgtagataaggccagttttcccaaggggcttttagcagctctgcaagtcgagcttgactccttaaagggaagcatacccttccagtcaaagccttggtaaaacagtttctccaattgcatcatactgcaaaagaaaatggattcttatggcactgatgcaaacaactacattgctgtaagttaagaatactcacaactagtttccaaattctggggaagccaggcagagagggacatatatgctccaaattttgttcacaggagtataccttaatcattaaaggccataaatagttcaaaataagtttccttgactctgaaaaacaaaacaagggtcagcaatattccaagcaaaagtcaaaaagatagcttcagttttctatgagttcggtccatttagttaactcttgtttgatattcatgaacatttcagctctttatgagtcctgtacatttttccttttttccaatgtcacaatctccaaagttatcagaaacctgtatttgagagcacctgtcagagtcctgtggcacctgtcagagtctggtttattataaactatcttttgaaaaggaccaaaacaagacaacaattgttgggaataaaaaaattgcccagggtatttacagttagaaacacaattgacaaagaagtttggttatctctcttcttctcaaagaagtctggtttacaataacataacaaccttaattatgatgatagcatatacattagacattagaattttaaaaatcccatacaattttggaacacatattaatattattcatcaaaatataacctaaataatattgaacaccattttggcaattccatgtaactaaacatgtcaaatgatcccttttacctctcttttggatactccagggccctctgtagcatccaaaagctaggtgtcaggaaaggcaattttgaaactgaagtttgattttgggaagcctattaaatatgttagtggtttaaaacactgaaatagaattccagattaccaaaagttatttattttgccaaacgatgactcagaaatttaaaaaagcaaaaaccttttataaccctttacaaattttgctaaagagcagattagtgccttaagagtaccttgttgtgcttttatttcaatgctcaatttacaaaaaaactatataatacccttttgaatttagtcaatctgttcacacactgaatttttgcaatattaatttttacagtccttccatcatttgtttaaactgtcagctttattttatctaattcaaaacagtcctttaaacctaggcaagaatttacatttccatgccttcttgtaatcttttactaaaaacacatcttactgttcctacataccttgcgtgtaaatctatttccagtagtttcaattacatgttataatggtaacccctagcaattttaagtttaatgtaaaacctggtaagttgttttaattatgtgctaggttcaggcaaggtttgactccttccaacataattaagggtgtggttaattccttatgtccccaggccttactaattgtcaagctggcaagttgaaaagttcttaaaaaccaaaaaggcagtttataaccttaaaacatttagcaaacctagtatctgacctgcataatttagttcacctgtgtatatttgacaacatctgcattttaccaataatctttaaggctgtttttatttctcaaagattaaagtcacatgaactaaaacgtaccacagctttaatcttccctttaaaaaaaatttgatccaagcacttgtcttccattagaccaattaattagagcttttttatagacatcacacacacaacacatatgtaactacacagacaggcagaagaaaaccagcagccataagattttcatttgcccatctcctatttggattattggcctctgggtggggccctttaagagacagggctaggaaaacatgcagcttttaaggcctaataaacaggcatgactgggaggcaaaatcagagtttgagagggatctatccacttttaattcctggggttccatgagaaaaacaggtttcttcccaaaacggagtggtgccttgtctgtttttcccaaggagtcccatggccccaggagttatcttagggcctgccatgcatgcactgagagtggcaagccaaatggagaaaaataatttagtcaactgaggaaaagcctttttccagcaaagcaagatacccaaagaggaaaaagcataaaggccttttaaataaaccataacttggacatccacttttaattaaactgagcactctctaagaaaatccttttaactcccttattacccgattttagccatgccaagcagctagtatttctggctttcaaactttactaacgttaacctcgcaggtgaaaccaacaagcctcacttaaggttattatttcactgtgagcgtatgcggtattttcgaaggggataagggtaagcaattcttacaaaatttagaacctttagaggtaacccagtgaaaggaagatgtaagaaaaaggctaagcgttgttcatggtggggaagagaatcagcaaatggcagaagtcacacagatattaactggaaagtactcatttcctaagccaggattgaacctaggcatcattgtgaaatgaaaaacaaaaagcattgccacatggttacaggtcacaatcccaagcacacaaaacaagatggaggcctgcagcaaagtttgctgttggccatacaggaagtcatgcaaagcacaccagattggctacagcttaagaccaacctcacaaatcctttttcataattaaaactttacagaaaatataaaccctgatagttggggtcctggcctggtaaaatgttttcttaaaaaaaaaaaaaaaagccagctgggttctgtggctcaggcctgtaatcccagcaccttgggaggccgaggctggcagatcacctgaggtcgggagttcaagaccagcctgaccaacatggagaaaccctgtctctactaaaaatacaaaattagctgggtgtggtggcgcatacctgtaatcccagctactctggaggctgaggcaggagaatcgcttggacccagggggcggagtttgtggtgagccaagatggcgccactgcactccagcctgggcaaaaacagtgaaactccctctcaaaaaaaaaaaaaaaaaagtctgggggaagaatctcttatttttatgccagtgagtttctccaacagggagagaaacttgggagctggggagccaccagtttgcccgtccagccgacattcctgacctccaggaatgacattttaatatgggggggcataatttctctaccctcagaagaagtcggaggacaaaaaggcttagaagccaaaggaaaaagactttttggtttgcatgtcactcacctttccttaagccctacgcctggatgccaaaaatgttgcagaactttctccttagttccaccaaaacggggtttttgtcacttgaccaggaaagattagattggtagacacataaaagggtgaggagcggaatttattgggagaaaaggaaaaaaaagaaagaactcagcaaagtgagatggagtcctgctaacaggccctctacctcaccgattgattcccaggtcaccacacgagctaaagagagcaggctacttccctgcataaggcgtgaattccccgtggctccacccatttcccccagtgctcgtgtctggctccagtctgctgtggggatgcccatacaagcctagggcacaattgttgcctaatctgcacaaagcatctgatgtaaacacttgcggggcaggtcagagattctctggggaccccctttttatctgcctaggcgtttggctatctcagtagcttttagaatctggtgaaagctctgcattttctccccagtaaactgcaagatgcatatacagcatgctgcctacaatttcagggtatttccatgctctgctcaaaacagttaagaacctttgacttaggatggcttgtagcaaacccaaacctgcacgttgacttctgcaattagtaagagtcatctttggaaatccttaagttgatgaaaaagtattgtagcaggacaagccgcagacaaaactcctcagacaccgagttaaagaaggaagtggtttattccgccgggagcatcgggcaagactcctgtctcaagagccgagctctctgagtgagcaattcctgtcccttttaagggctcacaactctaagggggtccgcgtgagagagtcgtgatcgattgaccaagcagggggtacgtgacaggggctgcatgcaccggtggtcagagtgaaacagaacagaccgggaagtttcacagtgtcttttctatacaatatctggaatctatagataacatatccggttaggtcaggggtcaatctttaactaccaggcttaggtcaggcaggcccaggcctggtttcgggtctggttcctaggcaccgggctacctgccttttgttttgcttttcttttctgagtataaaacaatataaaacaatatgagagggtctgtctctcttctctcagtataactgctttatgtgctcaaacttcagttaagatacaatatatgacaaagaacaaatatgcaaaataaaattagtgtttttaattacagacaaaaaagagagaagagcataaagttgctgagagcctaaaattgaacattaaaaagttaataaatgcacttatgatgcaacttcactccataaactttatctgcaatggcagttctaggaagaactgctggttgggcttctgatacgtgctagcactggagaaatcactgaaatttattctctctcaggtatcaagggcatccatcttgcctctcccggtttttccttatcctcaaaatgcacattaaaaacatagacaatattcatataaagtgaaaaatatccaataagttgccattattatttatatgctttttctttccaaaaatattctttgtaaaaaatttctaattgtgctttatattttatttttattttatatttggcaattaaaaagttagcattttgaacatgcactttcactcataaatcatcacctcaaataaaaaatacatacgcaaagaattagattagactgggtaatggaaatgtgaagtctgagtattccaagctggagttttgtaatctgcaaatttactacattgaatcagtatcagtcggcttttcttaatttctttttcttttctttttcacatgtggtctcctgctctccctgtgtctggcacctcttcttgcagctgtgtaatgggggctcagtcactgagcttgtcaaaggtctactcagatgtggccagcggttggatgaagcaatgatctcatacatcttgtacggggccctcttggtaagaacatctatcaaatggggtatgacagcagatgggatggtttgttcattgcttgggtccttattgcatattaacaatggggaaactgccctatgatatgcaaggattactaacagcaggaaggtgtagccaaatgtagactttcatgagacttttcaatagtagggtaattgctttaaaataagcatgtaaatttcccctttctctttcctgttgtttggtggtggtgggatgccatgcagggccttcagcatttgcacaacaaccgaatcatccaccgtgatgtgaaggggaataacattcttctgacaacagaaggaggagttaagctcgttgactttggtaatgactgcttgtcgtttgttttcttgacgtgtgcagtttagccaaaggggacaatttattgcaatctcagaagactggggcttctctgctacaccataggctgagggacttttccagtcaaacacaagctggagggggtgggggctccagatggatcaccctaggagatgctgtttgctaatctagtttcagctttagaagcaattttataaagattgaaaataaaagtgtttcaaaagaagaacttgatggaaaaacttttcggttttctgctaagaatttcacatctcagggcaattgtctataatttacattttgtcatttcttcttttgcatatgaaaagagaaagcagtttggtctttcaaatgactttcactagccttaggcatacttattcccagggagcagaaggtaaaatagtcctctgggcctgggagctaacatccttttaaattgtgtttactgctgctacatgtgaggctggttgaactggaaacattaacgggaaatggaagtgtgagaggaaatgcagggcaatatcacctaaggccagagaactattaaatatccccttgtaatatcatatgttgatattcacaaaacaacaaaccatttggttttttttttaagtttattgaaggtttagtcttctaaatgagttcagcaatagtacttcagagtcattgttacaaataatgagaaaacatttagtgaaacactttaaacgtgtttttttaaaagaatatttattgtcttattgctaagaaagagttcagtgtaaacatgtatcagtttatcacttgctcagaagaaattacttaaaaataaatgaggttggtttagacgtactagtctatttttactgaaacacaagcaaagaaaaatagcagagggagcattttgtttaagtcttatgctcctctttataaggaatgatataactccaataatatgctgtgtgtatgacatttgaattgtttttgcacgtgattctggggactgtaaatatgttgtgaggggaaacagactgaaaggatgaggatggggtgggaattgatactgatgtattcactcagcagctttgcgatttgacatagagtaaatgttcctaatctttccattagaaggttcctgaactttcagtggctgcaaaaggaatgtctagaaattaaaaccagaaaggtatagttgtttttaccaaaattgtggtggaggacttggtaaaatgggaaattatctaggtcaaatagactttaaagagcttcttggctctctaataaagagaatgtccgcagtcatcccccaataaacccacagatccttggcaaatctatgctcatgtttcaaaggtgtgtcctttgctaagaacacatagtgttcagtttctaagtttttgtcatcaatgacattagtggcaacccttgtcattctcttaaggtctatgtgagacttctgtgtggtataaaagaataccttatgtgtgtaaaatgctttgcaatttataaagcattttcacatttgttctcctatttggtcttaagaagaaccctccgtgttaggtgtgactgttgtgattatccctagtttaaagatgaaaaaactgaggctcaaaggtgaagcaatcacataattagtaaaaagcataattgggatggaaaacattgatttttaatcctgtggacctttacgctctcgtgatatgaagaagacagttggttaaaggacattggagttacattagaattcaggtccccaacattgagccccagataatgttattagtcattttctttttccatttgacaaacacagctttcttgccaggtttccaggcttctaggcaagataaggcactgaaatctttttatgtctacactgatgctctgttacagatagtgcagccgatcttctttctccataaaatgaagccccttattaagaaagaagtcatgtgaaataatttggaaatataataggatgatattttggattgatcctagttgttgatatttttcttttgatttttgcagtgatatagacagggatgtccattagggaaaaaaaaaaatcctaatgatttaaatagagtgataaatgctccagagttgtagtttggcaactacagctagtgagccaaatatgacctacctcctattttcatatggcctatgagctaggaatggtttttacatttttaaatgattggaaaaaaaaaacccaaaatattctgtgacgtgaaaattatatgaaattcaaatttcagcatctataaataaagttttattggaatgcagccacattcattcatttatgtgtttactatggctgcttttgtactattgcagcagaactgagtagttgtgacagagaccatatggcccacaaagcctaaagtacttatttggcctttgtggaaaaagtctgccgattgctggtctagcatcatactttgctcacttttgaattctgatactctttccttataggtgtttcagctcaactcaccagtacacgtctgcggagaaacacatctgttggcaccccgttctggatggcccctgaggtaagctggaaatacctagttctttctttgcacttgttgaatgccttggtactatgcctttttatgggtaagtcatatgctttgcagaatttttagggagaagaaagtccattatcctcattgaactttaagagtactagtttggtcagcgatgctggtgagatgtaacctcagaaaagcaagattaagttatagctatcccacagggcaccttcatgcaattagaagaaagtgtccctccagaagatgcagccccctccaagggccatgtcttggcaaattcatcagcccttgtataaattagaaaaagtcaacttccctggatacatgcagccccagaggtatatggctttgtgaagagccagatttcagcaccaactggcctacagaactatatgcggtggccctggttgtttttttgttaccagatacatagcaacttatcttgtgtactttgtcggctctctgtagtgaaacatgggatttattcctaatttaggtttggcatcatcacagaactctctggaaaatgacgcatgtagaagtttggggaaccttccagctagatgagtcttgctctgaaacaccagtgcagtttagtttttcaggtcatttaattccacagtatgctgacctttgcctgagagcagctttctggattaaacaaatgggttcttttaataaaaggactcagatggtcacctccttagatgtctttccatctctgcatgatggtatttcctctgtgtgactgccaaagtggtctcctaacaaagtaagtggttcacactaatctctgcttaaatttcttcagtgacctcccccgcctcccatcatctatggctctttctttcatactgggtaatggataggcccattttaaagaaaaagaaaaatgctgcaatttccagtgtttacctaaatcttaaatatttcttaaataggttttacaaaacataaaactagatataaactctttgtcatttttatttgcagaagtataaaaccaaaaggaaaaaaatgtattatgaaaaaaagctattatacaatgccagtaacattcaagtaagcagctctacttttatgagacaaatgatactgttttgtgactctccattgtcctttgcagtgtgcttatgtttcaggacacaatagtatgggttattttcagtctggcacacctacaaccacgtaccatgcggctactcagttctcctactactttattccatttcagctagcataatctgtttgttcaaacagcacctcttttgatctccaactgttacatctgtgttggcttggtgccaacttaatagtaaacataatatgaacactgtgtgacaaatagtcatccagatgatctagactatgtttttactcctccttctcccattattattattattaatacaattatcactgaaacaaaaccaaaaacataaaaagttatctagggactttgtgaatcccactttgagaagcactgcaggataaagtcaaaacttctttgaattttgaataaagctcttaatattccagcccctatctatccagccttgtttcagattacttcccccaatttacttgttcttaatgccccaacagtagtgaacagcaggtgactctccaaatccctactgatgtgtctttcctttaaacccttggtgtactattatatcatctggaatggcccccaggcctctggaaaattcctccttaattgacaagtctcaaatgctagctctgctgggaaacattccctaatcccttgcccacattgaggctcctttccctaagtttccaccacgtccttagaccctcccttaatacagtatcaccactgcattgtagttgttggcaggcaggtctcccaactggactcaggtctgccagggacttgggatgcctaagctcttaatatagtgcttgatacagagtacatgctcaaaaaaattatctgttgggtcaggagcggtggctcatgcctgtaatcccagcactttgggaggccgacgcaggcagatcatttgagatcaggagtttgagaccagcctgtccaacatggcaaaaccccatctctactaaaaatacaaaaattagctgggtgtggtagtacacacctgtaattccagctactctggaggttgaggcaggagaattgtttgaacccgggaggcagaggttgcagtgagcagagatgccaccactgcacttcagcctgggtgacagagttagactctgtctctcaaaaaaaaaaaaaatctgttgaatgaatgaatgcatccatctgtaagaaagccaaagggataagatgcacttgcaggacagtttgaggacggcttcacaactattgatattagcaaatttgtctgtagatttagatctgttctgaaaggaaagcataactaaggtcactcaactaatatttggggtgatataacacggaagatggtattcctgttctactctagagcaaattggtattttcaaaatcacaaaatataattaagagaagcattttcttggctttgtacatttatgtataaatggctttgtacatttattaagaggtgtttgtggccgggtgtggtggctcatacctgtaatcccagcactttgggaggccaaggtgggcagatcacgaggtcaggagatcgagaccatcctggctaacacagtgaaaccctgtctctactaaaaatacaaaaaattagctgggcatggtggcgggtgcctgtagtcccagctactcaggaggctgagcaagaagaatggcgtgaacccggaaggcggagcttgcagtgagccgagattgtgccactgcactccagcctgggagacagagtgagactccgtctcaaaaacaaaacaaaacaaaacaaaacaatcaaaaaagaggtgtttctgactttccaactttaactggattgaataaaatatgtggagtgttgaccgggagcggtggctcacgcctgtaatcccagcactttggaaggcggaggcaggcgaatcacaaggtcaggagatcgagaccatcctggctaacacggtgaaaccccatctctactaaaaatacaaaaattagcctggcaggatggcaggggcctgtagtcccagctactcgggaggctgaggcaggagagtggcgtgaacccgggaggcagagcttgcagtgagccaagattgcaccactgcactccagcctgggcgacagagccagattccgtctcaaaaaaaaaaaaaaaaaaaaaaaaaatggagtgtttctgtaggggacagtttatggtgagctttttgctcagattccctggaagtggttcccctgttagctgggaaaagccagcactgcatcctgcctgttgcagtggatcaattgaaaagtaagcagtttaaggtatggacaccttgacagcacgttgcaggagtgaatgtctgactgttcaagtgcaggattctctcaggatgtgtgattgtgtccagtatgctctgggacccaggctgtagctcttgggaatcaggcctgcactattctcacatttttattttctaaatggagaagcattttttccaacaaagtctctttttgcgccataatcctccataggaatgtccacaagaacaaccttccatttttcaattcaattcaacaagcatttatattgtccatctgagcaatgctttgggtcaagaacagtccttgaaagtataatcagtaatggttcaaattaacactgtcttcatatgatggcctgtgtggtatattgatcctgatatgctttcacttctgcttgtatgaataagtggtctttagattaaatacgacaatgcacgcaataccaatgccagtggaataagagcattgcagatgacttgtgctttatttttaaaatgcagctgagagatccttgatcctattttatttttgaggaattgaaccaaattgttttttcccttttttatttccatttttattccacaagcttgagtaagtgtaatatttaattcaggtagctattctacaaaccgggtagctaatggaatgtgaccacagtacaatcaaatgttgatgagcagtcaagacacacagttcactggggcacctcaaagctgcagcatgaaatgactatcatattgtcaatactccctactcattttctcttactacctcatttggacactactaaagttgaaagatactggcagagtagtatcaactcagcagtgtaggagaagagttctgtgggatgcccttagtgtattagaactttgaaacaatactactggggaaataaattgcttggcataataaaagggttaatctaaaagtcaagatcagtagaatttttttttaaaagatggggtcttaccatgttgcccaggctggtctccaactcctaagctcaagcattccttctgcttcagcctcccgagtagctgggactacagggcatgccccaacatgcctggcttaagatcagaacaattttttataaactaaacacactgtatgtgagtagcatactgtgactacaggaaagattatcttaagagagaaagaaaaatttcacatggagactatttaggagattatcatgagcaaaataacttgaacaatagataattaagtttctcgtataataagatcagaggtagtttgttccggagtttgttgatttagcagctcataataatagagtcatgaaaacttccgatttttaaatctccctggctatgactgctgcaagctgcatggcttcattgttctgggactgactttagggcagttatgacaacagtgcctgtgaatatctgaggggcagtagtggctccaacatgccaatagccacaggtgaaggcactcatggtgcaaccaaacagcgagaagttaaagtgggttttcctcctctcttggggttgaagacttttccaccctatatttattttcccggtctgctgtaatcaagtagtacaaactgggtagctttaaacaacagaaatatattatctcacacttctggaggctagaaatctgaaaccaagatgccagcaggcttcctctgaagcctctaggggagggatcttgctttgtctcttcccagctactggaggtttgctggtgatctttggtgttccctggcttgcaagctgcgtaactccagtctctgcctttgtagtgccgtggtattttctctgtgtgtcttcacatgtccatgacttcttataagaacaccagtcccgtcggattagaggcccaccctactccagtatgacctcatctgaattcaactaattgtatatacagtgaccctatttccaaataagttcacgttctgagattctgggggctaggacttaaatgtatcttttttttggaggacacagttcaaccaataacaagctcccaaatactaatatttagcacccttcctttgtattaaatcattcaagtttccaaggtaattagtcaactatttagaacctgcagggctgcaggttatagatgctagcatagtgagaggctcagctttgcctgtttacacacacatacacaaccacctcccctactccacacacaccacacacatagactgtctgcactctctcagcctttggtgtttgaggcaaacgtggttctttctgaaggtacaaagcataccaaattgccttcctgtgtgggcgcccaacacccccagacttttgttctctcctacctactctcaggcaaagcatttttaaaattattattatctcctgagatgtttggccagctcatagtcacttccttgaaccttctctttacctgattaagcctctctggtctcctgacctaaaactttagcctgcattttatgcacttaaaaaaactcacaaaaacaacacagtcttcctattagccatgtttattatctcttttctcctccactatctcctgacagccaatttcttatagtaagtaatatgaataatagtatcccacatttgcgtagaatttttacaaatagtattttaaaaacactgtcatctacctgtgagagtgccactcgggcatgattacattgatgttgtagataaagaatctaaggctttgtcaggccaagtgtccatagacacagagtgggtaggtgggtaatggtgactggaatccatattttgtgacttattcaactaagggatttccaatgtaacccgtgtccgctgttaatattgctcaaccaatttttatatcaaacacatgccaggtaatatcctggcctatagcaaaagggatacaagcctagtttatgttgattaatggtaatggcagggggttaggggtagttgatacctaaaaaactttttctaccatcacatatagcaaagaattaaactcagtgtttgtaagtgactgaaacccaagagaaagaaccaatgttgtcattatcgtttttattgaggacaccagtagactttgaaaataatggcttatatttagctgatgtacactgtgtggccaggctggttgttaagatattaaactattcattctggatggtaaatggctgccatccagagccccttgagtgctcctcagccaccagaggtgccctgtcttttaccctgggacatttctgacctgatgatccagtaactatggggggaaaggtctgtttgacaagcagggatggccagtgccacatgccacctgattgtcagatattttgaacattgcacttgctaagcagaggcatagtgggaaggaaactttcacttactgaggactgactctataccagggactatgataggggcttttaaaatattttatttcattttcacaacagctctcaatagtggatgttattttctccatttgatcactgaggaaagtgaggcttaaagagctataggaggaatcgagcccaaattcacatacctagtaaatattgaagctgtttggcttttcagagagcatgggaatgcaagtcccattttgcagatgaagaaaccaaggcagggaaaggatacttgtactctcactttacagtgtgttcatatgggatattcattgtggaaaatgtgtaccagctaactgagacaccagctcatataacaaagacacgcagagatatagtggaagtatactctgaaattggagtgtgagacatcattttaaaagatgcacatgaaggacctatcacctataatttataggttgactacactttgcaattccgccatgcattaaggatctagtatatgcagcatcttcctaaaacagctaacggtctgtttctgtactggaaaacagacttgtggataaaataaacatttgcttcttttcagaaaattctccccctctttacttccatctgctcattgttgcaaacaagagctaatcagctgagcagagaaacagatgtgctgtgacggctccaaaaatgggtctctctctgcctggcaaagggtcgttgacaagggacggttgccataacaactagcttacactaatgcagaaatatcgcaagctttttgcagccactcttgcctttgttaattatgccattcctagtaaatgatacgataatgctatttcctttggcattgccagggctagagatgacaaatgagatattttgtgtcaaagggctgagaaagacatacaacactatagagttgaattattattattgtcattattaccattttgttccctaagctctagctaatgggtttggttcccaaataagagctagcgtttagcgagtgcttactatgtgttaggtgctaagtgagttgtgtgtattaactcatttataaatcttacaacactaccaaaaagggggtgctattgctagtccaatgttttaggtgaagtagatgagtcacagaaagtaattattcttgtccttggacaagttattaggtgatgccaccagagtttgaacccagatatttgtctccaaagtccttacttttaaccactataccacagcaaattatttaattgtgacaaccagtgtaccagataagtcatgaattgttttttcccccaattcttaacatagatgagaattatccttcctaatatatgaaggaaaatgtaatatttcaatctgatgctaaaagccagtgtaattaatgcccaagagaaggatatggaaaaaataaaataaagttctttagaattgaatttaggagatttacattttactcttggctctgccactcattttctagaaaatgattgtggttcagttattttaatatggcttcagtttgaataaaaaagcacaaattttagagtcagatagatttgggagcaaatcatagatacctgctacccatataaccagtaacctcaggcaagttacttaatatttctgactagtaaaatggggagaagttaaaagaggtaaaatggggagaaaaaaacctgcctgaaaagataaaatgaaataatgtactgcaactgttcagggcagtgccagacgcaataggggcttctaacagtggtggcatatgttgcccctatgcctacctctgcttagcctgttctcatctgtaaaaaagaagaaattggcttaggtagtctttgccttttaaggtcctgtctattttacagggaacatttactgtttttagagggaagacctgctttcagttctcatattccatggctctgatgttccacaagcaatgagggtgggatctcaccaagttcccagtaagagtgaactaatgttgatgccgtggctgctaggttccattttacctggctctgttaaaagactggagattcatgggaccctgtctgccggtcatatcactgtgaggaatgcaggctttgggagctcaggagagttaaatgagaggtttagaacttcagatcattggctgaaagacctgcctaccttctccagagacattcatctctgagattccgtaaccttttgctgttgcctggttcaccccaggcattgtgtgtcaggctcaaagaaacagattccttctctggttctgaggctggccctggcctgcctacatttgcagagtggttctgtcttctaaggccctgaggcacaacccagacgctcagtgttccagcaggcaaacggcccaaggtgcaaggggtggaaatgactggatgcagccccaggttttcacctcagctccagcgatagttccctctcagctggagctctgtggggaggttgagtcatgtgtcatatgtcagtgtggaggcggggggctgattctggaggaggtggtgatatgttattaccctcttcctggtgggtctaaatataagaccctatctgagggctttagatcccagatgtgcagaagcatgtgaggcccagagcagaggcctcacatcccctccgagtgctgagtgagaagtgctaagccagaaatgtcaaaggaacaactaccaggagcatttggaatttttaaggctgtcctcactcctctctggggaggtgagaagggtcaaagcatctgctgttgccccttctcttcatccaccaaagaggaaaagaggaaaaactgattctgttactgcaggaacagaagtgtttgctgaaggaatgtcagagttggcctcagctcttcctgagctctgggtcccaaattacccatgactgacctccagtcagtgcctccactgccctgttctgggtacagtctcagcccatgaaagagaattcccacccaagccaaactctacatttgcttccttgcctgatggccactgagccaccatgagagcaaatgggggagagcagtcagcatgagggatgggacctcagaggagccttgagtaggatgaaataggaacaagtagaggcagatggactagtgtttcttgtgctctattatgtcccgggtatttctcatacttttttgtgaggggaagtgggggggtacagggtcttgctctgtcatccaggctggagtgtggtggtgtgattttggctcactgcgacctccacctccaggtctcaagcgattcttgtgccttagcctctctagtagctgggattataggcatgtgccaccacgccccgctaatttttgtatttttagtagagacagggttccatcatgttgcccaggctggtcttgaactcctgggctcaagtgatccacctgttttggcctctcaaagtgctgagatgacaggcatgagccacagtgcccggcctcccataccttttttaattttagagagctaaacagaatcactctctaacaggaacatatgacattctcaaggacatccttatttgcatggtgctgtcagcctgggtgaggacagaaaccacagatacttgccgatgaaggggtatgtccaagtgggaactttcagatactctgattgatttgcttcccttcctgtttttcagatgtgtcatgaaggagaaaaacatttttttcctcaatagtttctgattgggtgctctccttcagttctatcccctactagctgtggccttgagcgcatatatctcttaactttctgaatctgtttcctgacttggtgtaataatacgtgacctgacaagctgtaaaatggactgaattgtagaggttctccttgtccttaacatactctggtggaaatggagcactaactggcaaaagaaaggggcagcaagggagagtgaagggacagggaagtgagaggcggcaggaaatccatctgcttaatgcttgcgtgctgtgcctatgggttcatagcgtagatgttactgtgactgcggctctctgaatatggactctgtttggaagtggctcagcattctccataattataaggattcccaagagatgcctcactcaggaaggtggtaggtaaccatggagtttgctcctgctttggtcatgaaccaactgtgtgatttcagacaaatcaactgactctcccctcaggccctcagttttctcttctgtaaaagaagggggttgaatgagtgaatcttaaaggtcctttcattgtccatctctgtatgaggaagctctggaacaggcaaggacagtgggattgcactgggtctccaagcaaatgtgctccttcactttttgagtaccaaggacacatacgaaatttggacatgctaggagttctgtagatattggtcctgagtctgagaacgggacttaacacacaagtaagaataaatgatctgttcccagggcttcagggaatttaggtgcaaaaatcagtgtgtgggctgacctcaaacccagagtgagttcctcttctaccctccactagctatggtgggaagctggtgtagtgtaagcgtgctttgagtgtttttaatttgaacctggctttatttctctgtagacttaagctgaaacttacaatcctgggaaaaaagagacccatagaacatcacattataattagagaccttcctgaagttcataagaacagtctaatttaaattatttctgacaatttcatagtgtacaaaatgtggatttaatcttagctctagttttagttttatgaaagaccatccccctgccaaatacttcaatttcagttcatctagtccatattccctttacaaaaaaaaaaaaaaaaaaaaacaacgaatctcaaatgtatcctctcttgaaattatgtatcatcataggtaagaaacttcatttgtttattcagtatctcagcttataacactttaagatgttcatttgtaaaagtgataaaaatatttgccactggaatatttatactgtaaccacaatttctgattccagagaagttctgacttggaaatctttatgatcaataacatttatcaattatgctgcatgaattgtgtaagcaaattaagaatcctatttgccttcctacctctcagcccatcttatttgccagtctattgcctgcatttttgggctcaaggtcagccaaggattaatagctttaggtctgtttgccttgcctcttatttagctgaatgtagctcttgagataacagcattttgcctgtgtacttgagtgaaattttaatcctgacctttggttataattttggattgcatgaatgattctagtaaggtgagaaatcagaacatagaaggcaaacctaattacatttttaatgacatttaaaaatattagtggaaaattagtctgaataatacctgttgtttaagtttgataaattatttcttatgacagcaaaaatactataatactatttgcttgaaaacattgcttaaaattacattattggaagaaatttcagcccagcagctctctgacataaaattcgataaatggtttaactattttattagagaaactaggttttctgaatctagaagctcatatattgactgtttttatccctttcacatatagtataatacagatgatctttctggataatgaagatcttgagatgagaagctgtaagctcaggttcttatacaccaagtctttgtgcaagagagggtggaactcactcctatcttggtaactttatcaataagtcctagtcatggatcatgatggcccgagaaagtgaaagtactctactcatgccctgtgcttacagtagaaagggatatagttgggaagggaatttcatttgtaaaactgattaaaaaaaatctgccactggaatagttatactgtaactacaacttctgattccagagaagttctattttagaaagccttatgttcaataacatttatcgattatactacatgaataattatgcttcattcttctggtattaatctcatggggacctagtttttttttttgttttttttttttcgagacagagtcttgctctgttacccaggctggagtgcagtggagtgatcttggctcactgcaacctccgcctcccatgttcaagcaattctcttgcctcagcctccggagtagctgggatcacaggcatgtgccaccacgcctggctaattttttttttttttttttttttttttagtagagacggggtttcaccatgttggtcaggctggtctctaactcctgacctcgtgatctgcctaccttggcctcccaaagtgctgggattataggcgtgagccaccacatccagccagggacctagttatataatcaagatacaacctttaacctgccaacttcttgataaagaatcccagcagtcaacaaatactccagaagaaagaaacatgcccttgaaaattaaggcaaacttttcaatatttatttatattttcaagacaaaaaaacataaaattcgcttctttctattatagaaataatccatgctctctatagacattttagaaaacataaaagatcttaaagaagtaagtagataaaataattattagccatatgtcagtgatccagtgatatctactattaacattttagtgccatagtaaaagctgaataaccagcattttcataagcagtgcttcggatgaggcccatgaaaaaggggttgcttggtttgcttgcaaagaagaggtacagggagataaaatattttgtcaaagtcacccagtgagagggtggcaaaaccaaaacaaaaatgccaggctctgggattttctagcattagtcagaggtgaaagtctcttcgtgacccaagagctgctgactgttgtttttctctgccattttctggctggtggctaaggaaaggaacagccatcttcaacagaacacagctgaccctgctcaaggacagacaaggggatgatatgtgtcaaagcagttgtgcatgtggtttcatcccatagattcccgcaggagaggggaggtgttccctctgtggggtaggagggagtgactgggggtagatttaaggagtctggatctgtgaactccttagcctgaagaaggctaaagagaattgcctcaacaattgaagacagataatgactagcctttgctccaaagacctgtcaagctaagccattagtgaaaacttgtttcttgttctcaatcttctccagaaagaaaagtttttggcagctaaggtggtaatgaccaacatttgggagtctcaacccactgctaggtaaaatagctattggccttgggcactaaagctgccagtgcatagatattgctagtaatccagcattagtgtttttcttcttcctaaaataagcagcagtgtagtctaactgtaccagaagagccgtaagtttgcatttcaaggtaggaacctggacatgctccattaaccagcttccaaacaattgctctgtcgctgaagctcatcttccttaacagaggcattattacagcaaccagcatattttcatagaccttaagaccttctacaaaacattggcaacaaaatcccctcaaagttccagccatcctgttcacacctcagaataatgtactgttcactctagctaatttgtatggcagtgttagcctctcagtttgagatactacccaaagatcacttacttggaagtcgcaaagtcgtagaatattagagctagaagggatcgtataggttatttatttccaccttaccactttatagatagagagaggtcctgagaatataagtgatttgttttcagatgtgaaagggtgtgcatttgggatcctggacctttgtcaacaccgtctcatttctctccactcctttaatgtgacttacagaacctggaaaacctggtcccaaagacgtgcacttacttgccttcgtcagtctcctttcttaatggagcatcctaacaactgattcagagagttctttttgaggtcaccttctcctggggacaagggaagaaagaccattcgaccatccaagcatccttaactcagctctatttaacctagagacaaggagaatgttgagctaaagagaatgatagtagtgttttctcttaaagaaatagcttcagactttggtattggattgatagggaatcccattccaggatgttgaccttcagttgccctgcatcctcttaagagtgcttctttaactctcatcgtatgtgtaacctgcagaaagggctgtttcctcctggtaaggagcaatcctgaatgagagacccccaaagaagatggagttgaaatgacaaaacctcagaacacctgagcgtagtcaaaatatgagtgcagaagctgataattttaacaattttaaccaactgtaacttttattatagatagcacttatatggcaatgattcatttagttatccttctccctgcctgggttcaaattctggccctgacaattactagctatgtgatgccaggtaagctgtttaaccatgctatcctcagtttccacacctgcataagtgataatagcacctactttgccaaattattatgaagattaagttcagtgtgtatttgactttctcttcccagggcctactatcatgccagactaatgagtactcaataattatttgtgaattattttattagcataattttcaataaacttccttggaaggctgaacttaaataatttctttgttacatgatgcactgaagagaagaattaggccaagatatgattttctattcatcagaatgagctgaagataatgtttgtctgtaaagagaagttgaaaccagatacaagttttgaatattttaggacaacgcttgagaaatgttagaatatctccattttcacatttagatatgttcttagaattgccttttgtgtcccatccaagttggctagaagctgatttgaatttctccgcaaaagttctagactatgggtactagatactttttattgtcttgcttagccagcagtggtctccttctaaaatcttaagcatttagagcccatatcctttattggacgtgttagtacacattgtcttagggcatttatagttgtcatggtttgtcatttaattatgataggttcaccttatattttgattggccatagctcctattggggaaggacagagtcttatttctctctccctcacaggccctatcacagtgtcatgaataacagtgaactatttgttgattgataggtctaaaattatgtttgtcttacactttcgaaagtgtcatttctgaaagggaaggtgttgaatagccttctctagggatctttaaaaataatgtaggttctcacctgattggggtgaggaaagggaggtctttgggggcaatgaaatggcctttggttctgaaactggaattgtttgaacttcagtttgaatgtacatttgaaaataacgtgttaaaagtatgacaggatattctattcagaagatggggctggggccaggccaaggatgtggatatatagaaaatgttcttcagctcagaagagaagagtacagggcaattatgagaacaagagcacagagtttagagcacattttgcacagttggcacattttgccaggccttacaggtccaatgcactgtttctggaagagagcaggaatactagttttctatcactgccataacaataccacaaacttagtggcttaaaacacctgtttctggccgggcgcggtggctcacgcctgtaatcccagcactttgggaggccgaggcgggtggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagtgagactccgtctcaaaaaaaaaaaaaaaaacaaaacaaaacaaaaaaaaaacacctgtttcttagtcttaatctgtttcatgctgctataacagattatctgagactgggtaatttataaagaacagaaatttattttctcacagttctagaggctgggaagcctaaggtcaaagtgctggcatctggtgtgggccttcatactatgtcctcacatggcagaaggcagaagggagcaaacccagtcctgcaagcccttttcatggtagcattaatccattcacaagggcagaattctcatgacctaaccacctcccaaaaggatccaccttccattggttgcactggggattaaatttctaacacatgaattttgggaggcatgttcagaccatagcagttatcttacgattctctagatcagaagtccagtatgagtctcaccaggctaaaatactcttctccatttcgaagtgtcccaggcatctgaggcttaatatatcctaaatggaggtccactcttcaccccaaacctgcccctcctactgtcttcctcatcttagtaaataccaattctattctggtggttgctcatgtcaaaaactttggagtgttccttagctctcctttcttctaagccctgttcaacaaatccagttggctgtacattcaaaattatacctagaatctgattatttctcgccatctcacaatctctcatctggatccctgcagtaacatatttaactggttttgtttcttctcctcataatctatcctctgcacagtagccagagtgatcttgctaaaacataagctagatctgtcactcctctgctcaccacagtcagtagtctcatttcatttggaatgaaaaaaactaaagacattatgatggcctaagagggtgtctctattactctggtcttcctgtgctcaccattataggtgttgcccctccctgatgttttggatcatcagacattgaagtctcccacctggccatggccatgggtcatcctggtggcagattttaggtcaaataggagttcctggtcctccacatcctctggctcactcctgacttctcctatcgccattgtgatagtcatcagagtctgagtgtaggagatgttcttgcctgactcaaaaagttgataaaaacattcctccacagggttacagactcctcaacccaatgacaagcccagggtcattttctggttctgctgctcttgtacctagtcaggccaagtaactggaatggcagttgtttctgtgatgcataccattgttggagtttgaggaggggaaagatgctcttagaaaaagggaagggtggagtggggtcatttctactttatgttaaccatgtgggtcttccaacatctctctgcttagttggttatactcgcgggaatttcatgcatctcaaagtacacaagcatctttgagaacaattgttgcttgttattgaattcagtagctggtaatgaggtgaaggatgtagacaaagcctttccttaaagaatagcagggttgggatggtgtggtatacatccgcttcctccccttgcactgttcttgttacttagacggttcaatgcatgctttttaaaaacaaaactgacacatttgtaaaagctaatgaacgtataagataataaattggttatacacaaataaggcctagaatgcacacatcttattactggaattcaatatcatcgtggccaagaaaactgagaacggggctaagatcagcccagggcctttttaggacatctgatgtggcagtagggttgatgtgtcatgtcctgcttttgtccaataggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaaggtaagacacaagatggcgctcttgactcattagttctttgtgaaagcgtctggttagagggataataaatagtttgcaagcaatttctctccaaacctgacaaagcctgattgtgaaatatattttctttgaaaaagcaaggggggctgggggggacagagaagaggatgttcctgaaagataacataccccaaggaataataagaccatgttggaacaattgcctatttttagcactcagctttttctgagatactcattttttgtactttgcacgataagactacgaatggaattgtggattaagtaatctgtctaaatgctagtgttttctttttaattacatactttctctagtattcagtgaaaacatatgtatatcatattgctgtattcactcagactagcattgaaatgtatcagaaaatgttacatcagcgctatatcttactctccatcccttaatttccgtctcagtggaaaattgtgcggaaagaggtctgtttggagagcatttaaatgcaagtatactttctattctgtgtattcattagtggtttgtacaagaggttgggttgcctttcattggaatcgggctgatgtatggccagctcacggctctagttatggaatatgaagctatccagggactccttcccaaccagggtgcagattgagagataatttgtaccttccatatgtctctttcaaaggaaggctctgggcaggctgggagccatttaactgccttaacaatacaaatgttgacctttccttatctgcacaatcacacagctatcacagcctttaaaaatttctcctgattgcaatttgcatttctgattaggtctatttatatgcagatgaggctctctgatgttcatcatcataattttatcattttatacctaatccagatgtgaacaaccaccaaccactattccaaaaatgattcccacccaagccagagttagtctttttgcctttttcgaatcacaaaaacaggtcacagcgattagaggagcagacgaagcacctggctttttaaattaatagtctggtgaacattcaaaaggatataagaatgcaggagctaaaagctgcattgtgtatagtaataagtcagaaaatgggaaatggtgtctggaatgatttgtgtgtgtgctttgatttttttttacaaatggtttacccctcaccatttatttaatgtggcaacataatttcctgaatatcaggattaaggtgtagcttctctttagcaaaataatatgtacttttgataagagatcatctatatttttttcctttcttgttatgtatttgtatacagaccaggtgttcaaaaatttcttaaggtgataaatgtgaggcagcaaagagtgtgtgtttttggcgggggggaggggggtgtatatgtttaaatagacccttccactctattgactccacttagcttgcttctgtgcccagccaagcttcttctaataatctcatattctctcaccactcatctcttccatcttgggagaagcctccagatctccagatgtggaatacgagtaactaagtctctactgcctgcctcgggacagagtggatcccaagaattgggcaattgttagaaaaggatccttatcccaacttagtttaaggctttgtttctctccccctagtgtaacctcctgcccttttaatgtctcttggttcctgtgcaaatgatgaatcagattgaactaggcaatgtcagcaataatcagtcagcagattctcagtgtgattatgtgtgctcatgtgtgttcaacacttgccattgtcacaaccttaatggctgacgtgacattcttggacaagaatgataagaggttttattttattttattttaaatcttagcatatttacgtacattgtacagcttttttcttccccaaaccaggaaaaatatgttgggtttatattcaccaagttatttactttaaaattactctgtcaattagaattgcacagttctctttgaagggttatggattgaccaaatgtgtgcatcctgtgtgagtgctacttaatttctagtgctaaaaatgtatcctttccccagaaaagctctttgatgaaaagtacagaaattaagcatttatgtattttaaaaaggcattcaaattatttacctgtgtgtttcattggaatcgatctcagttcagtgcctgtctgtctgtctgtctctctttctctctctctctctctccgccccctcagtggagaaaagcaaatgaaaaataatgacaaaaatcctttgaatccatttggcttcagaattaattttttttctatttgaatgtgactattttcagtgctttggaattcttgtcagtgaaacaatgaaatccttttcagggtatgttgggatccagaatactgcgtgtggcttcttcctctggctttcctcactgaccttttcccggcaaccctttctttactggaaataaattgagtaaattacccagtaagggaagaaaataaaaccttgatggagtcagggaagaagtgactttcacaagttaaaaaaagatttatgagttaatgaagtgctggttacctgtgagcctcagatgtcaataaaacaggtaattaggaaggttccctgggtattgtcaggaaataggtggcaacttgccttgatgtggttgatttgcctgtacatgggtctccttgcttttcccttttcttcctttatccaccttctcctttctcttgaccttcacattagaagatcacacacagggtcatcgtgacctgctttgaaatactgcgtgactcacaatctttcccactttgcaaacacacagaaattacctgctgattggcagagcatccactatttgctgaacctgtcagcatgtgtcatctcgtctaacgcctttgctccaaaaaagtcacccctctctgactgtcactgctctgtctgctgctatttttccccaggagttataagagagcaaatgagtgaatatcatttctctcaacatcagtggattcaactgtctctcatgactctttactgaggacttctttaaaattccaaaggcttaaaaggatcttgaagatgacctggatatatttttcccttaaaaagagatccgtttcatagatataattgcaagaatcaatagagttagtggaaatatacaattatgttggtctcttgacaagcaggtatctttccttagctttgagtctttggctaatgacccccttgacttccatagaggggagtgaggaaggctgtgggcatcagtgtgggtgggttcactggtcagtcactgacagctgcatcatctgcccatttatttggggccaggtatgagctgactctgtccattgtctcatcacacattgaatatttccactttattccttgtggaaaaatgcagaatgttttcaggattctcagcagaaatgtctttggctggaaatggacagcacaggctggcctgaacattccagtccctgaagctggtgattatcccttcctaaagagaatttccctgcagtacacaattcaaaaaaaggacagctcatgatcatcaccaatttgcatttcggcttgtttccctcactaaatctaggttgttccaaagtcacctggacccagctgtatttgtttcttagggctgctacagcgaatgaccacaaactcggtggattaaagcaacagacatttattctctcacagttctggaggtcagaagccccacatcagcgggtcagcagggccacactccctttgaagactctaagtaagaatccgtctttgcctctgccagcttctggtggctccagcttttccttggcttgtggcagtatgattccaatctctggcttcgttttcacatggccgcctttcccacgtctttgggtcttcttttctggtctcatataaggacatagacttagggcttatcctaattcaggataatttcatctggggatccttgccttaattacatctgcaaaaattcttattccaaatgaggtcgcattctcaggttctgagtagacatatcttttggggttcacaatttaaccctttataccaaccaacttttatgtttaccacattccctgagaaactaatttgcgggcaagatacaagacaattagctcaatgatcatggaaaaataatagctgctaagatctgtcaagtgctaactgtggggcaggtacagtgttctgtgttttagaaacagaaatgcatttaatccccacagcaactctgtgaagtaagtactgttaccactattttttccagatgagaaaactcaaggatgttaggcaggcttgcttccctccttttcagggaggaaaaatgatttgaatctgagaagtttgactctaaagcccacatgttttgctactacattgaaaagttaaagcccttccttaaattatattatgtgttgatgaattacatatgttgagcactgaggggactggggtatatggaaatgaatagaaagtggtcctgccctttaagaagcttacagtccaatatctttcctcctcccaattttaagctgacattatcaacctgaaagttagaatattattagcatcatgactgaatcagccaagaaacggaagaacagaaatcaagagtgttgtcttaggtgaacataggctgtctctggctcattgatttatgacccgcaaaccagaaatctctcccttctccaaactccccttaaaggaactgctttttagttcctaatttagaacacttaaggcaagtttttaaactaaagaattgtggaatacatgttacataaaagtagaaaaatacttcaggatatcttattctcacccagaagtttctgtcttatctcaccttccttgcaaagttgtatctcccgtgtcagggctatttctagtatagccaacaccttctctccctttgcctttctcttattttttctcttcccttttatttatttgtttttttttttagtaggaaaagctcattcttggtcttgaggaaaatggaaatctgtttctggcatgctaagttggaacacactttctcatgaaagcagtattttcaatggttatttaggaggaagcaatagaatagctgaagttctctactttggatgcattattagatttttgtggctaaatagagctgtatgacctagtctaaggacttaggcttcctctagagctttatacttatggaaaaagaaaatgctttccaagttcgaaactaccagtttacaaaagagctttggagcacaatccactgggaacttgggaatgcccttgtcctctaccctaggacgccttaaactttgttcgtccagactcaggcttgggttgggtgcttgagttgcagagatgacagagtttttgctgtcaaggagcacatcagtttactgcctcctcctcatttatcggtaaaggtgaaacggagagagtttggataacaaaaaggagaaatcagatttttgggaacccagggtctggatccttgtggactgcctggatgctgtgggtagtggggcagatgggcaagtcactgcttgaaatatttgtgtgtctatttgaagagcttcctcagggactcagtgcctacaatcgactctcatcctgaaataggatccttgggctaaatttttatcttacataggcatttttttttttaagattccttttgatgctgactttcctaattcacaaaccaaattgttcctatatgggaagcagtagtctctgcctgctcctccgctgtgagatgcagaggcagcagggagccctgagtcaccagtaattgtctcactattacagaattgtcacaggacattttcctttagggctgtgaaatataaaggaaagaaattaaaactaaactattgttgaagtgtaatgagtgaggggtgctgagtgtttaatggcacagtgaggctggatttgccctggggagtattggtttctcttcaccaacccaggtcacttagctattggccttttgagcaatgaatccccacgatccaagcttcactcataaagcaagaagtgctagaagaattagcatcatttagcatttattgagtgcctaatagcaaaaaaaaagttttaaaatattccaatagaaaaacagttatgttttatgtatctttttctttctttgagagatttctaatcccatttttaatggattgccttcagtatgtaccctgttccagatccccagaatatcttctgggcccaggacttgacactccctttccgtgggaacccagtagctggaggcatctggcagaaatgccccagaaggctttcactctgtggaacacattgccaaattatttttaaattcgagttgagcagctggggccattcagtcctatgtaggtactgcttgctgccccctgcctgagtcctggcaggcagggagaatttagctttgcaaggtttcatttggggatcaggtgacaaagcaggagcatgccttcagggactttgggtccccaccactactgagtaagaagctcaccctgagagacaggccaaaggtgcgaggggttgattcccagcgctatctgtgccttcttctcattaccctggtatattattttggcacaactgactgtggctaattccaacccacctcctaaatgatggagagatgggcaaagaagtaggcaaggaaacagagctcaaaattgtgctagagttgaggcaccctggtttcctctctactccagaaaaaactaaggaataaaggtgaggaataattataactgcctttatgggttggcataatggtaggggcaggggtaagacagggatgaggagcaatgaggtgatagtctaaaggaaggttcttcacagctggagctatccattcctggaggatcctagagtcaagtgaagccagtatcatttgaaggaaaatatagtatagtggtccagcatggttgtttgtatcagttaactactagtatgtaacaaaccatccccaaacttagttgcttaaacaacaaacatttatgatttttcatgagtctatgggtttctctgggtggttctgcagatcttggctgggcttgctcatgcatctgtgatcagctgagaatgtggctgtgttggttggtctaggatagccttggctaggatgacttggctctggtccatgttgtttcttatcttccagcaggctagcctgaggtagttctcatattggtgacagggttctaagcacagatagaggaaggaacagaaaattggaccagttttgctctcaagttattacagtgttctacagtcaatctacacgggttcaactagcagctccatcactttcaagttcaccagtgtgaacttgaccaagttactgcatgtctgtgtgtgtcagtgtcctcccttataaaatgaggatttgagtaatgtcgacctcatagagctattgtgggagttaaagaatgtaaattggtcagaatatttcatagtaagcattcaattcatgctggatgctaccaaggaaaatatctcaagggcatatttatactgtaaggaattttctttcccttgtagctgaagaattgaaagcttctattcaaaaagagccacccatgagatcagtcatttgaaagttcagctaattgattgattgatgattgtatgaggaattaagagagaatgaaggctgatttctgaagtccctactacttacattgcatctatgtgaaggactctgccattagtatccattgtcacaactcctttgtaaatagacacactcttaagagatacggtcacatacacctcaccctcacacacatacatgaatgctgtgacaggaactgcacatgaggaagcagggctggccttagtctccactgccatgatgtctacaacgagtggtgatgctgtcatcctctgaagagaactagggccatggtacttttcctttgctatcagttctatcagtttttgtggtggttttgtgctcggttgatgagtcgtatgactggtcttggctgcctccttctatagggtccttttagcccccttagtaggttcaaccttctccagggttctagaaatttttttgtctgcagataaagggacaatagcaagagttctaaacttagggtcattgattcaaaattgagtcccattttgctatttcctctaccacagataatattttttttcccagccccacctggaaaggctcaaaacattggcaaaaggagacagaaaactgaagccaggtcaggggattgtaaggagagcacctggttgttgcagataagttcaggtttctttggggaggagtgatattccaggtgctgagggaatatacaagtgagactgctgccccactatcagtgctcttagaattctggagaacagaaacagtattagaggagtagaaaagggagaatgtgcttcaattcttcaaataagggaagagggcagagcctgcagactactatctggtgagcttgactttcgccttgggataattactaaaatttttttcattttctccttgaatagtgtgtgaattcttagaaagctgtgatcactaggaattagcacgggttcattgtaaacaagccatgtcagacaatttccttatttggtgttaatttgagactggtatgaatggggactattttagacataatatatttgtatctttggccttaagtaaaatttgttgtgacatcttagtggctaagatggaaaaacatagactggagaatggtggtagcgatggaatcacagcccgggaaagattgtgttgaggaacactggataattgtgtcaatatgaacacactggctggggtaaaattgtgtcagtatgaatacactggctgggggataatcgtgttggtatgaacacactgactgcgggaagttctgggggcctgaggcaggactctgctgaccgtcctgccaactgaacatttaaaaatatttaatgaattggaggacattggcagcctttctgtcacattcaaggaaggggtggttggtgtgctggatgacaggcttggaatcccacaatgtcttagtcgttaaaggcaatgggggtctctaactagcaaatagaacccttggaaaccctggtgaactgtataggctgaaagagccgtgagtttaatagcccacggtgaaaaatgaattatttgtagctgtaagcccaatggggggatcaaacagtaagaccatcttgcatgaaacatgaggtttgatagagcacccactaccagcatcccccaaagtggctctgtcctagccagatggaatgatgtcttccttctgagtgccagaccaaaactgccataagggagtcttaccctggcagaactctaaacctgaagctgacatttcaaaccgggattcagatgcctgggttccggttctgctcctgctctgttactattccatcatttcacctttcagaggggaataaatggctaccattcttgagcaaccatgttctgcactcagataacagggcttatgtaaagttttcttaagtatcctctctatattctgtggcttctcaatagacaggaatgagaatagctactaactgcagggctggggccactcactgcagcagcaagtctcacccaggacagggtcctcagtccttgatatagataagaatatcctgggagctttaaaaagataccagtgcctcatgtataggtatgtaacaaacctaacaaacctgcacgttgtgcacatgtaccctagaacttaaagtataataaaataaataaataaataataaaaatataccagtgcctgggtaccattccccaggaatttcaatttaattggtttgggtcaagttcagcatttatatacaaatacaattaattttacaaatataattttgggataacatgcatattattttatatttacaagttccctagatgattctgaaggggttgagtaaaacccttccctgaaacaactatcagacccttgtttgtttttttgttgatattttaaaactacagagtctccctctggaaattcttgctcctaccttcccaattcccaccccatggttgataattgagaaatgagagatgatatcaatggaagtgtgttgcacattatgaagaatgtaaaagtagaaaaaaggattctagcagaatagccagtggtgaagttatgggttgaactgtggtgtgccccctacaaacaggtatgttgaagttttaacctccagtactttatttgcaaatagcgtcatgtggacataattagctcacttaagatgaggttatactggagcagagttgatccttaacccaatgtgactggtatccttataagaagaggaaaatttggacatggacacacacacacacacacacacacacacacacacacacgaacatcatataaagacagacacacaggaagaaggccacactagaagaggcaaggaaggatcctcccccagaggcttcagagggagcatggccctaccaacaccttgattttggatttctagcttccagaactgtgaaagcataaatttctattgtttaaagccacctggtttgtggtgctttcttatggcagccctaggaaactagtacagtgactatctagtttggagtccattgctcctagtagcatcctggaggtctgcctagggcatggttagggatgggacaatgcggggagggagggaggtattcttcctaggagagtcctaggggtgggtataggagttagattggccagccttccattcttcaacccccactaagtggcatttctgtagaagtcaagacaatcttacataacatacttggcagttctcagtctgcttctagataggaagtgggtacatgagagattcttcctctcccttgcaccagacagctgagccaagaacttccttttctatccagactcttctgcagtgctcagggtggagaagggagctctacgtttcttctctgagttcttcccagactcagtacttccagaatgaagtacagaataaagatatggcttttaatgttcaatctttccatctcagaacacagtagtacttggggacattgagaggtagctgttgtggcctatctggcacaggtcctctgaagttaggatttccaagaagattcaggtgtccatctgggcaagggtcaagcacctgtggaatatgatccgaagagcagcaccatctgcttcttatgtctcaaaggggcttaaaacctgcacagagggcaggcagcatcctgacatcatgcttcatcctggtcatggggaatgggcattgacttctaccaggcctcatcaaggtttcgttctttatctccacgccaagcaactggcctatttagggtgtcttagttcattcaagctgctataacaaaatacctgacttagactgggtagcttacagacaatagaaacttgtttctcacagtcctggaagctgggaagtccaagatcaagatgtcatcagatttggtgtctgatgagggctcactttctggttcatagatggtagcttcttgctgtgtcttcacatgggggaaagcatgagggggtctctcttaggcctcttttatgaaggtactaatcccattcatgagaagtctgtcctcatgacccaattttctccagagaccccatttcctacaacaatcacactggtgattagatttcaacctatgaattttgaggggacataaacattcagaccatagcacaaagaatggtgaggagcactgtgtggggagtcccctcctgaaccctcctttcttcttgcttcctctacatctgaaccttcagcttttgcttcctttggcctcacattcttggtggcaaatttggcttgctctctggattcatggttcccagctccccctctttctgtgccacctgttgtttggactggaagctcttgtgttcatgctgcattactcatcagtcttgattggcaagacccctcctggctgcccttactcctacagtccacacttatctctgatgaaaatatctctttctttcctccttccttccggaagggtgaagggataggaagtctcccacttgaagggctgaggaggggtttaaagttagtcaaacctaggcctccaagtcacagggatcctatctgcctgataatactgctttatatttatgtggttctgatgtcttcaggctcagtcccatactagcaagatctgagctgcatacctcttgtgttagttttaagaaactgcagtaaaaaattaccatacatttagtagtataaaacagcacagatttattatcctttagttccgaaagtcagaagtctgaaatgggtctccctgggctaaaatcaaggtgtcacagggctgtgttcctttctggaggctctaggggagaatctgttttcttgccttttccagcttctagaagttgcctggatttcttgacttgtggctcccttctatcttaaaagccaccagtggctgctttagtctttctcacactgcaccactctgacactgtatcttgtacctccctctcccccaatttaaagacccttttgattatactggacccaccaaggtaatccaggataatcttcctattttgtcagctgattggtaaccatacctgcatataaacttaatcctctcttgccatataacctaacatattcacaggttctgggtattaggacacggacatctttattctgcttacaatgcctcccaaagtattgcccaagaatttttagaaaccttcaagagcgtgctccttatgtactcatagccattttgagctatcattattgtgtggcctctgacttgttgtttctcttccatctagttcttctttggccacgtttactgcctgcttatctaccatcagaacatccaggcctttgcaggctattcattctggtaactcccaaagcctccagtcctgggtgccaaagcactggtttccactcagaggaagggaggtagcccctatcctgagctctgagccattctctgccacttaggtccctgagcaactctgcttgtggccagagcctcaccattttggctctcctctctcaacagagtaacatcaactccctctatataaacgggcctttctatttttatccttattcttttaattagtccaaggagctagagagaaaacaaacccacaccaccctgcccaccttcctccacatttcctctgccccaaacctaactcttttggcctcagcagtttagtaacagatgttcttattcatatcaacatttgcttgagggagaagagaaataagggagagttactgactattcctgtggtctccaatgcaggagcatctgaaccaatcccttggagtgcagacagaaaatattagaacttctgttcctaagtatttcaaatcaaaaaacaagaaaaacaagaaacaaattatgctttcctattactaagtataaagatgatcactgctgcctttgttcagtccaaatgttggacagtcctgtctggttgggtttacagatgaatcatgaggcagctccacagcaaaaaggctgaggaagctccacttgtgggttcagttctagaattctggaaagcattttcatttaaaggtgcctcattagtggttatatggcaaacgtccttgagtttcaataaagagaccttcacaaaatggacaagtggctttaaaagatttctgtaaagaaacctcagactgaatctaattctactaatacaagcaaaagtgagcaacagaaaaaaatggctgaaatgctggcacttctcctcctatgacaagctcttcatcagccacttgaggtttagaacaatgacaggctaatcagatctgccaagaaatcattaaaaaattcaaaattaccatgaagactattggaagtatggatttatatccactattattgacgatgagccctcttcataagtgtgttttatgcatgaagttattagcatgacaccatcaagattattcagcattcagatcagaaagataaaccactacaattcaactacaaaatattttgggggtactgttaaaacatgttatttatttcatcttattcattttaaaatttagtagcacttgttcacaattgataagaaaggaagtagttactggaccataggctcaacatttgttactgatgaagtgtgcagtcaaaaaagtttggaggccactgtcttaaaccagtagctttgggccccagttcagccactgtgaaatgggagcattccctgacccccatcacaggacgtgacaggggtgtggcttttctgtccggttgctgctgctgctcaaacccattacaggaaggggggcatgcagatggacaggtgcaggagcccaagtgggcgtgtgttacagtgcgttcctttaggtttgccatccatggatggcttaagtgttaaccagctcagtagatcctctgcctttttgcaagggtagagggccagtgtgacagccttctgtatccagagttcttgtccagtgtcccggaagaactgggtcacacacagacttgaaaaatgttgaatgtggggttttattgggtggtggaggtggctctcagcaggatggatgaggagctggacaggggatggagtgggaagatgatattcccctggagtttggctgtctagcggccgactctcccactgtcccgagccaaatttctgatgttcagactctccttatcttctcatgccgttctgccattcgtctgcttgtctgtgcttctccttctggagcctggggtttgaggtttatatgggtacagttgagggggtgtgatgggccaaaaagcaactttttggggtacaaaaacaggaatgcctgttttcacttagggccacgggtattcgggcttgagggtggggcctttgccagggaaccgccctcttctacccagtatttccctgtctcctgtccgtgtcaactgtacatagcttttttacaattgtttgtcccttcacgatttacatttactgtcttatacagtttctttgattctttactgcaactctgataggtagggttcttttttttctttatgttagagttcagaggattcaggactcagtgttgtgattggctcaaggacacacagttaataaaaacaaataagtggcagagggcaagcttgaagagatctgcattcaatcaagattgattgcaaaatgcaccatttttaggaaaatggtttttataggttgaatcgtgtttctcagaaaagatacattgaagtcctaatccccagtgtctcagaatttgaccttatttggaaatagggtctttacagaagtaatcaagctgaatgaagtcatcagggtggaccctaattcaatatgactggtgtctttatggaaaggagttaatttagacacagagacagacacatagaggtccaggaacgcctgggctaccagaagctgaaagaggcaaggaaggatccttcccttacaggttttagaaggtgagtggtcttgctgaagccttgactttggactgctagtttctggaattgtaagacaataaatttctgtttttctaagccagctggtttgtggtactttgttacagcagttctaggaaactatggtccattgctctggaaagggtctaggatccaaaagcagctaaaaccagtgatataatccagtacaaccataagcagaggaggaagcccagagactgggagtgagttttcctaggtgatatggctagttagagagatggttagttagatccatggctggatctcatacattcttactcctaagttcaactttgagaccaggagaagtaaatatggggaagttggcttacctctctcatcattaggcttggtgatctgccttgatctggcatagttcaccgttcttccaatgacttcaaaggaacaaatgggaaatatgttgcatctttgccttgatgataatgcacttacctgaagatcacagtcctcctgctggctccacccttcacccccttcctttccacagttcacatgttatcacttcagtgtctattaaaaaggaaaaaacccaactgttactaaatatgtatatctacaaggaaatagttcattggattggtaataatatgctctccaactggaaagggattttaaaaagtcaatgcacctggcacaaaattgtaagtaaggaaagaatgaccttaggtgaaaaatgtttgccaaagagtttggcaaaatacaagacatttaattaaaattattttaattctctaagagcatgtgtatgagtagtggcctacttacacatggactataagttgatgcttggaactagtttattcaatcacttattaaatatgttttgagtatttactatggtcaggaactgtatcaggcatggcaataaacaaaacagtccctgtcctcttggagcttacattctagagggggaaagaaataataaacaagtaaaaataaataatatgctaggtgacaatatgtccctgtatgaagaaaaataaaatgagataaagagaatacagagtgacagttggggtggggtttgttatataatgtgctgagagaaggcttctctgataagatgaagaaaaatgtctcaagggaataagggagcaagccacatttggaggaaacataagtgcaaaggtcctgaggtgggaatgaggtgggaacatggtggggacattttaggaatagcaaggagaccaaggcagctggagcacatgagaacagtggagagtggtagatgatgatgccctggagagagctggggacagatcatgtagtgccttatgagttattgtagtgattttgaatatttctgtgaatgagataggaagccattagggtttggagtggaaaagtaacatgaattagcttctgttttaaagggatcttctgcatactatgtggaaaatggaatattagggaaggaggtggtaagagtagaagcagagactcaaggtaagaggctcttgtcataatttaagtaagggataatggcagcttggaccaaggtgaaggtagtgagacatagttggattatggatataatttggaggtggtgctgacaggattgcttatggatttgatgtagggtatgagagggagagaggacttactgaaaatctcaagatttttggctcgagcaactgcaaaacaggagcttccattttccaagttggagacggttgtgcaaggagctaacttggtgggagtatgcagccgaatcaagagttccttttcagacattaagtttgagatgcaaatttatcatctgagtggtgacattgagtatgcagttgatacaagtctggagttcagtggagacacctagactggagacataaatgcagaagtcatcagagtctagaaatttaatgtcatgggatgagtagaatttacctgggcagtgggtgtgtgtaaagaagacgagagctcctgagggctactcccacatttatagataagaaagatgaagaaaaaccaggaaaggagtttgagaaggagtagccattgagataagagaagaataagggtagtattccagaggccaaggaagaaagggctaagagagtaaatgatcaactgtatcaaatgctcctgagtcaagcaaggtgaagactgagatttcaccactggatatgacaactcagagaaaactggtgatgctgtgaagagctgttctggggacggggggcgggggcgggcagtgataagacggctgattagatgtagccaggaagtgcctctcccactgagagaaaacaaaatatgcagtaaatcatcacactttgaacagatcttttgagaaaaaacactgaaagttgataagagaggtgatgcagacaccaagattgaagagggaggaagctgggaagcccacatggagtcactgagcaccacgaccagctcctggtactgaaaaggttctcaggaaggggtgaatgaaggaactctgtggcactacactcccgccacaaacttctgggatcccagctagaaaagatcccatgatccctatagacatttagatgggcaggaggagctgcctgtagagtagacagaggtaaagctagaacctgcatggcgcccagaaggttacactcatgtggggcagctgcagcaaaacaccgtagacgcccacccgcaaaggctctccatcttactctgaatgaccacagccctcactgactgccaacctgagagagagcagagctgcctttcctgcgggactcgggggggcgcatctgatctgcatgctcccagtgtctgctggcccctcccaaggcctcctgcctggctgctcccacaagagggtgtgcaaaacagagccaccactgtcctacctgcgtgttttgctagtggactgggagcagttcagcaccacccccagcacagctggtgcttgacccagaggggtcagaggacaaagccacaggccttgtcccaacttcccagggtgtgagcacaccacccagggatattgagctgagatctgtggccagagcttgagtgagagaggaggcctcactctcagaacacagagaggagtgaggcacaggttcatgtgccagcatgggaactgggtatcccaccctgtgcaagaccagtctgggaagggtgtagcctgttggctagccacagcttctacctgagggagccccatatccctgaacacctggaatcgtgcagcaatctgggtgcagaaggtttaggacaaaactagttgagtgggcctgctcctggggcagacactggagggagatctggtttgggaagagagagctgggcagaccccatagtcctctgctgggataaaagccccaggccacaggtgccacaccagctgcacacccatggcactactgctctgcctggggatcctacgcccttgactcattgcatcaccagaacgcctgcacacatactccatcacctgctctgactctgtcaacctcagagaatgagtgggtctccttgtgacctaacctttggcttgagccgctgctaagacaggtgggagtagagcccgccagggtccctactggggtgaggaaacacaggtgcaatgtcagtcattgtaggaggctccctcaaaacccaggagtggacttagtaagggagtcatctcttgtgctcctccccccttccctcaccatccctccctgcccggagcactgctgtgcacacactgaagtacaaaaaaggtacataactaagagcctatctgctggcccttactcttaagcactgtctactggattgcagcctgaattatacaaaaataagttccttcagcacccaacacctgtgaaactcaatacaggaaattagctacaaccaaggaacccatacagagcactggccctctgaaagcaccagaaacgaagccaattgactgtatacagcatacaccacagtcaaaccctgaagggaaaaaaaaacccagaaccccattcaagcaacagcaaagtcaaaaagaaaaacaccaggccccctgagatgagaagcaatcagccaaagagctccggcaattcaagaaatcagagtgtttccttacctataaagtattgtactagctccgcagcaatagatcctcaccaaattgaaatgtctgaaatgacagacatagaattaggaatctggatggcaaggaggctcaagattcgagagaaagttgaaattcaatccaagaaagccagttgttgatacaagagttggaagatgacatagccagtttaagaaataatcaaactgaacttctggaattgaaaaattcactacaggaatttcaaaatacagtggaagcctgaacaacagattagaccaagctgagaatttcagagcttgaagactagccgtttgaatcaacccagttagacaaaaataaagaaaaatgacttaaaaaaatgaacaaagcctttgagaaatagattctctaaagagaccaaacctatgactcattggcattcctgtgagagaaggagagagagttagcaatttggctaacatatttgaggatatagtccacaaaaatttccccaatttcacaagaaaggttaatatgcaaattcaaaaaattcagacaacccctgtgagatactatataagatagctatccctaagatgcatagtaatcagacttttcaaggtcagtgtgaaagaaaaatcttaaaggcagcttaagaaaagaatcagaccacttacaaagggaaccccattatgctaacagtggacttctcaacagatatcttacaagccagaagagaatgggggcatattttcaccatttttcaaagaaaagaaattctaaccaagaatttcatataccaccaaatcaagattcataagcaaaggagaaataaatttttttccaggtaggtaatcatgaaggaaattgatttccactagcctgctaccacaaaaatactgttaaggacatagcccacagactctataaagcaactacacaattgagactacaaagcaaccatattggctggttgttattagcaaccagctaataacatcatgacaggatcaaaacctcacataacaatattaaccttgaatgttaatggtctaaatgccccacttaaaaggcacagagtggcaagttgaataataaaacaagacccaactgtctgctgacttcaagagacctatctcccctgtaatggcacccatagactcaaagtaaagaaatgaacagctatcatgcaaatgaaaaataaaaaagagcaggggtcatcgttcttatattagataaaacagactttaaaccaagaatagtaaaaaaggacaaagaaggacattacataatgataaaagattcaattcctcagaaataattaactatcctaaatatatatgcactcaatgttggagcaccaagatttataaaacaagtacttctaaatgtatgaaaagacttagacacaataatagcgggggacttcaacaccccactgacagtgttagatcatcaaggcaaaaaactaagaaattctggacttaaatttgacacttgaccaattggacctaatagatgtctacagaatattccaccccacaatcacagaatatacattcttctcatctccatacagaacatactctgatcaactgcattctcagctgtaagacaagtctcgataaattcaaaaaaattgaaataataccaaccatactcttggaccacagtggaataaaaattgaaatcaataccaagaagatctctcaaaaccacacaattgcatggaaactaaacaacttgctcctgaatgacttttgggtaaataacaaaattaaggcagaaatcaaaaaattatttaaaataaatggtaacagagatgcaacataccaaaatttctgggatgcagcaaaaccagcgttaagagggaagtttatagtgctaaacacctatgtcaagaagttagaaaaatctcgaattaacaatctaacatcacacctagagaactagaaaaacaagaacgaaccccagagctagcagaagataagaaataactaagagcagaacagaacaaaatagaggctccaaaatacaaaggatcaatgaaaccaaacgttggttatttgaaaagataaacaagatcaatagaccactgactaagttaaaggaaagagagaagactcaaataaacacaatcagaagtgacagaggtaacattacaaccaatcccacagaaataccaaaggtcttcagaaacttatgaacaccttcatgaacacaaactagaaaatctagaggaaatggataaattcctggaaatgtacaacctcccaaaattgaatcagaaattaattgaaaccctaaacagatcaataacaagttctgaaattgaatcactatttaaaaattttaaaaacctggcaacctaaaaagctatggactagatggattcccagctgaattctaccagacagacaaagagctggtaccaatcctactgaaattatccacaaaagtcaaggaggacagactcctccctaacttattctatgaagccagcatcattctgataccaatgagacagtgaaaaaagaaaacgtcaggccagtatccctgatgaatatagatacaaaaatcctcaacaaaatactggcaaactgaatctggcagaacatcagaaagttaattcattacaatcaggtaggctttcttcctgagatgcaaggtgggttcaacatatgcaaatcaataaatgtgattcaccacataaacagaattaaaagaaaaaatcatatgatcatctcaatagatatagaaaaagcttctgataaaatccgatattcagttaagacaaaaatcctcaaaaaactaggcatcaaaggaacatcctgaaaataatgagtcatctatgacaaacccacagccaacatgatactgaatgggaaaaagctggaagcatttcccttaagaactggaacaagacaatgatgcccacgttcactacttctatatgtcatagtattggaagttctagccagagcagtcagaggagaaaacgaaataaaaggcatccatataggaaaagcaaaagacaaattatctctcttcactgatgatatgatttgatacctagaaaaccttaaaccttaaagactccacctaaaaggctcctagaactgataaacgacttcagtaaagcttcaggatacaaaattatcgtacaaaaatcagtagtatttctatacaccagtcttgttcaaactgagagccaaatcaagaacactgtccaatttacaatacacacacacaacctaggaattcatctaaccaaggaggtgaaagatctctacgaggataactaaaaatgaaacactgctgaaagaaatcatagatgacacaaacaaatggaaaaacattccatgctcatggactggaaaaatcagtgttgttaaaaaggccattctgtcccttagcaatctatagattcaacactattcctatgaaactaccgatgtcatttttcatagaattataaaaaactattctaacatttatatggaacaaaaaaagagcccaaatagctgaagcaatcctaagcaaaaagaacacagccagaggcatcacgtcactcaacttcaaactatactgcaaggttacagtagccaaaaagcatggtactggtataaaaacagtcacatacaccaatggaacagaatagattacccagaaataaagccactataaccatctaatcttcaacaaagtcaacacaaataagcaatggggaaaggactcccttttcaataaatcgtgcttggataactggctatccttttgcagaagaatgaagctagactcctacctattaccatatacaaaaattaactcaggatggattaaaaacttaggacctaaaactataaaaatccaactggaagcctaggaaatgctattatggacattggccttggcaaagaatttatgacaaagtcctcaaaagtagttgcaatgaaaacacaaatagacaagtgggacataattaaacacaaattgataagtgggacacattaagcttttgcatagcaaaataaaatatcaataaatggataacttacagaatgggagaatatattcaccaactatgcatccacaaaggtcaaatatccagaatgtgtaaggaacttaaataatctaacaagcaaaaaacatataacccccttaaaaagtgggcaaaggacatgaagagatagatacatctcagaagaagacacacaagcagccaacaaacatgaaaaaaaaaaagctcaacaccactaatcatcagacaaatgcaaatcaaaacaacaatgaaatatctcacattagtcagaatggctattattaaaaagtcaaaaaataacatgttggtgaggctgcagagaaaagggaatgctcatacactattgatgggaatgtaaattagttaagcagtggaaagcagttttgagatttctcaaagaactaaaagaagaacgaccattcaacccagcaatcccattactgggtatatgcccaaaggaaaagaaatcattctaccaaaaagacacatgtgcatgtatgttaattgcagcaccattcacaatagcaaagacataggtgcccatcagtggtggattggataaagaaaatgtggtacatatatatcatggaatactatgcagccataaaaagggataaaatcatgttctttgcagcagcatggatgcagctggatgctattatcctaagtgaattagtgcagaaacagaaaactaaatgccatatgttatcacttaaaagtggcagctaaacattgggtacacacagacataaagattggaacagtagacactggggactactggagttgggagaggagaagaagggttgaaaaaccacctattgggtactgtgctcactacttgggtgatgggaccaattgtatcccaaactgaagcatcacacactatacttatgtaacaagcctgcacattcactctgtcaatctaacatgaaagttgacattttctaaaaaaagaattcagttgagaaaaagagctgttttgatggagctatggggataaaaaccaaattggaatgggacctggggtgctggcaatagcctatttcttgactctagtgggtaattatactagtgttgggttatgtgtgatatatttcatagtaagaagagaggggaaacaaaaacagtcatttgagatagtgagcatagacactcttatgagaagtatgctttaaagtgatgcagaaaaatgggatggtacctggagaggaaaataaaggatacattttttcttttctttcgtttctttttgtttttgtttttgttttgagacggagtttcacccttgttgcccaggctggagtgcaatgacacgatcttggctcaccgcaaactccgccttccgggttcaagcaattctcctgcctcagcctcccaagtagctgggattacaggcatgcaccaccacgcccagctaattttgtattttttagtagagacggggtttctccatgttggtcaggctggtctcaaactcctggcctcaagggatcccacccgcctcagcctcccaaagtgctgggattacagatgtgagctaccacgcccagccaagaatacattttttcaagactagcctaggcaacatagctagaccctgtctctaccaaaaaacaaaacaaaacaaaacaaaacctggacatggtggcgagcacctgttgtcttagctacttgggaggctaaggagggagaattgatcccgtcaccagattgaggctgcagtgagctatgattttgccactgcattctagcctgggcaacagagtgagtttcaatggtcatcagtacatgtgtgttttaagtagggagactgccagtacacatgcataatcccatgatatgtgtgctaagtggccacatataatgtgatctttcatcatgaagtgtacacagtataaaaagttttaggggaaaatgcctggttgtggcatgatgctatgtttagcattgtttcgcattgtttcatgctatataggatgatttgatcctgtcagcatttaatctgcatctttttggctgatggtacaaatgtctaagaatgacatagattaggcaggcttaatcaaagttcaaatatataaatgttcaggaagattggaaatagaatataggatagcatcaatagaagatatgtatgtgtgtatatatatgtgtgtgtatatatatgcatctccaatgtaagaaggactactcaaagctggggagatgtagtgatcagtcaggcagagcttctgcccttgagagttcgcagtctgtttgaaactccatattgtgactaagtgtacacatcagacagaatggaatgaaggtataaagaaagggctctggaaatgtaaaggggaaaatgattaattttgaccaaggagatccagggaggccttgtacctcatttaagctgaacctacaaggggcagaattttcaaaaggatggggattggggccaaagtgatccttcagaacgttagtgagaacattagcaaaggaatagctgtgcaaaagtgggtccaggtctggagttgctggggtgagagacggggctagatggttaccttgagaacagaatgctgagcatcttggtagccatgcagagccattgggtgggactctggggaactggaagccatcagctgctttgagaacagtgacaagaaatttacttgtgttttagaaagatccttctagagacagtaaggatgagttggggaaaataggagggaggaggcaaggtgaaatgtgaggagcctgtaacaagcttgtaacaagcaaatcagcacagggcagaggatgggacaatgaagtaagagttggccatgtggagttggtgactggttgtgtgacaggttctgagggccaggaagaaatcaaagctgatccttgtccacgtttgggtagatatgcgtccatggacaatgtgtggaagccaccctctaaatctgggggtcccagtcagaaccctgggcctgtgctcttccctgttcaggttgctactctagcatcatctttgctcactcctttgtgtatttagggccatttgtgtatttggttatctctctcccaggatgtaagagcctttgaagtctaggactataaatttctgaatttttgtatctgtcgtagcacctagcaccacatttaatgcatacttaatctactcaaaatgcttttaaatttaaaattaaaacatgattttgacgttaccaatgatcatttgatcattgcatcattaaatgacttgaaggataaattggtttggtaggaattaggagatggtaaaaaattggagcgactaagcagcaggagatcttagaaccagactttggttatttattgctgtgtaacaaacaaccctaacacttagcagcttaaataacaatttgtggtttatcatgagttggtaggttagaaatgcaggcagggcttggctagacggtttttctcctccgcatagtgagtgtcaattggaggcatcaacttggctgctacattcagcaggcaattgggctgggttggaaggtcttagaagtcttcatttgaagggctggcctgcccctccacacctgtgggtgtttcttgtcaggtgggatgacagactgagaaaagaaagagacacagaggcaaagtatagagaaagaaaagtgggcccaggggaccggcaccggcaccagtctctgaattccctcagtatttattgatcgttatctctaccatctcggagagggggatgtggcaggacaatagggtaatagtggggagagggtcagcaggaaaacatgtgaacatatgtctctgtgtcataaacaaggttaagaaaaggtgctgtgctttgatgtgcacatacataaacatctcagtgcattaaagagcagtatttctgccagcatgtctcacctccagccttaaggtgattttctcctatctcagtaaatagaacatacaatcgggttttacaccgagacattccattgctcaggaacaagtaggagacagatgccttcctcttatctcaactgcaaagaggccttcctcttatctcaactgcaaagaggccttcctcttttactaatcctcctcagcacagaccctttaccggtatctcgggctgggggacggtcaggtctttcccttcccgtgaggccatatctcaggctatcacatgtgggggaaaccttggacaatacctggctttcctaggcagagatccctgtggccttcctgttgtgtccctgggtacttgagattagagagtggtgatgacttttaacaagcatactgccttcaagcacttgtttaacaaagcacatcctgcatagccctaaatccattaaaccttgagtcaacacagcacatgtctctgcgagcacagggctggggctagggttagagaatttttcttagtacagaacaaaatggagtctcttatgtctacttctgtctacatagacacagtaacagtctgatctctctttcttttccccacattcgtttaaatgccccagtgctctgttacatggcctcctttctttacctggctttttcacagtatggtggtctcagggtagttggatttcctatgtggcagtcatcatccaagagggtcctctcccagtacaggaaagcagagctgcagatcttgtaaggctcagtcttggaagttacacccatcacttttgccacattctactggtcaggacaaatcacagggccagcccggttttaaggagaggactacacttcttcaaaggaggagggacaaagaatttacagtcatccttaatccaccatgcagacattcaatctgccacgtgctggttgtgtgatttcggatgagttatgtgaactcttctagctgacataatatcagtgttattgggtgctatgagggaaagagatggtatggcaaaataccctgatatatagtagttgctcaataaataatagctactattattactactgtcttatgctcttaaaggataaatacaatgaaaattggaaagaggatatttgttggatttgacatttgagagactttgggtgatggcttagttttggaggatggcagtagcaaggtaaggagcaaaagctagtggcaaaagttaagttgtaagtggatttgagggtagtgagtgcagcttgtcagtgaaaagggaaatcctgctgtcatgtgggaaaatcaggttaagccaaaggggcaagtggagaggtagaaaatgaagatatgtgagaggagataattgttgagggcagagttttaaaaagccttttaaagattttacagaattcatatttagaatgctgtgattataagccagaaagctgttggggctggctttcataatggcaccccatctctttactgaaactgttcttacctcctgacagagggttgtcttgccctcacctcccaaagtcttcctctagttggagacagacttttaaagaatatgtagctcctctagatttttaagtcttggccttaatttcagagctccatgaattcttagcttataaattacatagctggaggttccaaactctgaaaaggtttatgcatttcagaaaggttctaaaagaaagcactcttttatataacttggaaagtaattgtgataaaaacctacattatatgtgaatttgagagtaattatagcatggctggggccagaatcaactaatcagagttattaggaacactgccaggtacccaattcccatgccaagatttgagtgatacagagacagggcacaggcaaggtcaggctaggtcagggcatgtggcaggcatgggccaagacacaaagttgttgtcaggtcagagggatatcaaaaccaggagcatcaagataggcagagataatggaagtaaaggactgttagtccctggttgcattacagtccaggtaataccagattttattgcttgaagaaaatttgtggtcctactgagagtctccttttaccttccagtcctgtacttttttctccttttctctagttatgtgtacatccctctatttcttggctcattctaaaaagtatttaaaaccatttacaaaagcacagagtatgcaacaagatgaaaacacatgacagaggaattttgtatgaatacaacataaaataaagtagaaaaaaataggaaaaagaagattaagccaaggggaggctggtaaacaaaatgcataccatacttttctgttcacttgtggatggcacacttacttctgagctccctagctgtcaaggcaaaaaggaaaatatagtcagttacactatttacagtattcagagaattaaacacaagcagaatactcaggatgggtaatcataattatgatttttatggtaaatccaataataatttttcagtgtagattgacataatgattataaagaaaaattcagtcaaaattaataaaacaatgcagcctcatgtatatagctccctggtggcttggcctaatacaagattaatttttggattttttagagtaatggattgagtgcctaccttgcccataaaactaaacagttctaaactcaacaaaacattaatttttaaactagctgtatgtcatttcttggtgtgctaagttaaacaaatgcatttctaggtaactgatcaaggtagtttgttgctggttatgggctaattacatttttgtaggatatctactagaaattataactctggttttagaatattcttaaggtcattctttcaatggctgatctatttcttaacagtttttgtcaaagagtcctgtgctttgcatatagaaatgtgcttattatgcttttttctgtcaagcagagaagtacaaggactctgacacaaatgagagaaggaagttccaggttcttatgtaagtgtcacaatacctaggggtctatagtgagttcatacctcttagttcacgacagattctcatctgtggggtcaaaagtttattgaaagtcaataaaagctgtaaacagccccatgtcatttctaataggtttcttctgatggcaatagagtgaaacagtggataatggaggaatgacaacacttggcatcctctgcccctcttagggaatatcagctgaaaatgaccaaacttgcagttttccagaagggaaactggtatatagattttattgttttgaaaaccttaaaaaagtttacaggtaattagaatacataaataagccaaatgaaggaaacaaaccccactatctgattaacatcttgatacacattttctcagacatttttctagagatatatttctgtattagagccaggaaagctagctagacatcttcctgttctcagtggctcaacagatgaaagtttattttttgttcacagaaaactcaaacagcagctgggggtagggtgggaattgggttctgcacctcacagtctttggggaacccagcctgacagaggctctgccatatttaacaagcagacccatcatcttgtagggccccttagtcctctgctggatgctcagcattgggttggcagacacaggtagaaagaatatggaggactgcacaagagtggcttccattccttatgcccacattccattggccaatacttagtcacatggtcatacctaattataaggctgggaatataatctagttttgtgtgcagaaggaaagagaattggtttggcagactagttggtttctgctactcacacataatgtattattcttccataaaaatagaattatgctgtatatacagttttgtatctgtttttaccatagagacaagataaatatcattattcacccaagatgtgggggtaagttcccttagctggtcttgagctctgtagtgttattcattccaaaggctcatgtcaactggtcaagacaatttccacttttcctgtcatgaacagttagtttatcttgtagaaactttcttcctcttgatatctgataggaacaaaattgcaaatatagtaatctgtggtaatatttattttcgaggacatagatgatggaatttgaagaattggcctggagacccagagtaagatattagtgttcagaaaatctggcatttgggcacatagttgtgaaagagcttagggttggacagaatccatgttgtagggaaaaaatggataaagaaactgtagaaagtccaggtgtggtggctcatgcctgtaatcccagcactttgggaggccgaggcgggtggattacctgaggtcaggagttcgagaccagcctggcgaacatggtgaaaccccgtctctactaaaaatacaaaaaaattatctgagtgtggtggcaggcacctgtaatcccagctacttgggaggctgaggcaggagaatcacttgaacccgggaggcagagtttgcagtaaaagaaagaaactaaaggaatggagtggcctttatgcatcacacctggatgacaaaggatatataaaagagaatttggaagtgatttctggagaaaagggcaaactccactaaagtaggatcctgttgactgtgatgaaaacaagccataatgggtgagaaaatggcagaatgattagacctagcaaaggggccaaggtagtgtgggcagaataaaagatgaactaaaaagaaggaatggtttgacctagagaatccaattgtaaaatctataggccagagtgatttaaagaaagaatactagtgaaaactggtcaaaatattaaatcttgaataatatagctttatgtgcataagactatgtgcttttctagatagtcatttattcacttcattgaacatttttgcctacatatacctctactacaaacttgggggctagaagggatgaggaaataaactttaaaatgcaagtcatatttactgccctttagtcctatagttgtctagttggaaaaacacataaaactgataaataatgtgataaataaaggggtaccaaattagcaacacacagatggaaagaaaatatttacaacacatataacagataaaaattaatatacataatatataaataacttcttcaaataagaaaaagattggccacacgaaaagaagacaaaggatagaaattagcattccacagaagaaaaatacaaatggccattcaaaacatgaaaaagaacttaacctggtcaaaccactatacatataaatcaagaaaatgtgaaataaaacaatgggacattgcatgattcaggtaagaaaagtgcgtgataggtgcacttctgtttcctgaatccagctcattgtagggattgaggtggggcagttctgcccgagtgacggtaagatgccagctgtgaatctgcttttgctcaggtggttgtacaccttacaggctgcctcttaatctaaggggttcctgccatacagagtgtgagcccggcatttaaagatatgtacttttcatatgacaatgcccccaaacattttaaacattttttcctaggctccagaggtagcctaggaaaacaatctgactgggttctccatatttggagtgagtgtattggtcaccaaagtggcatatttctaaaagaccttcaaaggaaattttgactatacaatatgtggttctcaccttaccacttcagaacctaaatccctcctttcccaatggcatgtgattttatgcttccattttttttccccacctatcagagtagcaaaactgggaaagactgataataagtgttggtaagaatgtggggaaacaagcactagcactttcaatggaagtattgatagaggcttttagaggacaatttggcactatcaaaatttgaataaaaatacacttggcacacttggcttttaagaatccatctataggcatgccacgtaagttcattgaggtaatataccagaatgttcattgcagcattttctcttaatattaggaaaaactaaccaaaagtagggaaatggccaaacaattaggatatataaattctgtggaataaaatgcatctgttaaaaagaatgtggtagagctgtatgtcctgacatgcaaagatttcaaaaccagaggtcctcaaactttagtgtgcatcagagtcatctgcaagccttattaaaacacagattgctgggcttcccagagtttctgattcagtaggttcggtgaggagcagggcaggaataatttgtatttctaaacaagtattaggagataacgatgctgctggtctggggtccacatgttgagaacaactgttccaaaacagtgttaaaggaaaaatatcaagttgcagattattatgcacaatatagtcctagttataataaatctttgcatatttgaatggtcataaactcatggaagaaggctccaaggatatacatcaaatggttaacagtgctttcctctgaggaggggagttattttactttttctatgctactgtattatttaaatattttacactgaggatatatttatatattacttgtgttaaaaagggaaattacaaaaactaacaggaagagtgcaaacccattctgctccaccctcagaactagtaagtgtgctccgtagttgtaagaaaaatagtactagagtttggatgagaaagactgatcgtgataggatgtatcctgaatcaagaaccagagattttaaaaaatgatagggtttagaacaatagaattcaaagctttactttgaatttgctcatctctcagactctggacgcagctggcttagatctgatgtatttgtttacttttctctgagcctgttctgtcagattttggattagatttttctagtccttggctttgacttcatgttgtttaaaacagtagtatccaccaacatgcacagtttagtctcctgtccttgctgccctgccctgtatagaagccctccattgcctgacagtcactgctagagccattttctatgtttcctccaacgtggcaaggctgttggaatggtagtttaggagaggacgtagcagggtttgagagggttggaggtgtgaccccagggaagaagagtactcaacaagggagctacaaccgatggctagccattgcatgaacttaaacatttggcccttttcactgtgtgtttcataagccttttgtagttgaatttggatggtaaatatgagataaaggaagaaaagtattttattccaacaaccactacagccagttccacatccatggagttgggtaacacttcaccgtttataagcatatccacatttattatctaagttaattctcagaccttgaaaggcagttatatttatttgccagatatagaaattggagccggtaaagattgctactaagtagcaactttggaagtcacatgcaggttttgtaacctggtttccaggggttcagaaatgagaaagacttcttcctttccccttcaggtattattttagtatttgttaatggagtaaagaaatgggtggggcacagggaatgttaaagtggtgaacatttagcctttaactggaaagcagcataatcttaaaataaatgttattttgtttttaaataatacacacatttccttcaacaaaatggaatcttataggtagctcatacatctcttgaataggggcctctggtgcctacagatataaataaatcacactgagagaatggtgaaccatgaaatgactctgttaacatgtcatctgtctagaatatattttcaactctccaacagaagtgtctcaattatgaagggaggtggcctaccaaagttgatactttgatatttgatgcttttaacctcctccatcagctgcctttgcctaagtgtggaatctggcccagtgcatagagtacaacgtggcctaatggctgagagtcattgtaactggtgattttaacatgcaatgaactctgaagctcctcaaactgtgctatcttgtgaaggcatgtatcagtgctacttgtctggtcttattaaggaattctgaaaattgctaattgttataataagaattttaaccacaaacaagccaaatttactgaattcttcctttatgcccagcactgactgatactatagtgggcttcggaaatgttcccaaaatgacttttgtttttaagttactctgaatgtagtctcagaatttgaggtggggactagtaggttttagtggcctatttgtattcaggtttcagtatataataatgtgaaaatagctctttgtatctagtaaacttgcagatgccagctgactggtgagggactgttatatttctacatttcatcttactgcttctaacccagtgatgtccctctttctaaatagtgacagaagggaaacttttttttttttttaacttggcccatggaaatgggctattccaatggttctcaaagcttggtctctgaaccgatagcatcggcatcacttgggaacatgttagaaatgcaaattcacaggccctagcctagactgactgaatcagaaactgggagtggggaccagtgatctgtgttttaacaagccctgtgggtgcttctgaggctcactcaaacttgagaatcctgggatggctcctttccaacccttctgttactgccttggtgtaaccctcatcagtctggaccactggagcagtccccagctggtctccctacttccagagttaacctgtccaatccattccccacatcagttggcctttgatttttgtctcatcaccagtggaatactcaacactctaaagggagcccaagttttcctccttcagtttactcacccacaaggagtagaccaaggcaatgaatgcagtagaccacagtagtgacagggcaggtagaggtgggagtggtaactaccatggtttgagagtgtctcccaaaaaccatgtgttgagaacttaatcccccgtgtcaacagtgttgggaggtggggcataatgagaggtgactggaccatgagggtggagtgactgtattaatgctattattgtaagagtgagttcttcataaaaggacaagtttggcccttttctgtttttcttttgccctttctttgcccctttgccatgggacgatgtagcaagatccttaagccttcagttttgtacgtctcaatcttgtacatctcataatactattctggtataatgaacagaaaatgtattagcttgtggataccaatgtctggattctgttacagcagcacaaaacagactaagatagtaaccattatgggaaggagtattgggtcaattgctctttctcctttttcttttagatgggttggggtggggtagtgtatatgtgtttcccttaggatcagctgtatttgccatttgagacttaagatcaagagggccaagattcaaaagtggatctccaggaagaatccaaagagactactcagcccggagccaaggccaaaaggatgctctgagcaatctatagtctggcccatctcacccagtgaccatgtgggggtttgaggtccaagcctcaactgataattaaaagtgatttagcctggagcaacccacctgcatttctgtcttgggaactggaggcgaaactagggatctcagaatgctgagaccctgggtccttgctgtatattatcccaataagtctagaatcctcctcttgcctcacacccctggatggcccacagctgcccaaaggatgaagttcaaatctcttgttacagcctagaaggtctttcaaactctagttcctgcttattttctcttgagtctgcctaaagaatcctgctctccagccgtatcaaattaagtctctgaagaagacatagtctttcatcgttctttatgtttaacacatactgtatcatctgcctgggatgctcatttcttccttcctctcacgtacttcatcttccatattccccttggacctgccactatctacatggtgaccatccttcaaaactcagctcatatgtcacttcctcggtgaaaccttcctcaaacccgtcaagcaggattggactcgtgtaattatcacataaagttggtctaatacatatttttttgtgacaattgctttattcctggaataagacattttcaggctcaaaaggaccgcaattccctagcccctggctattaatgagaggcctggagaccccactttaaatggcagtgggggggcacctggggaagccatagatgtggagctgggccaatcagatttcctttcttggaaattttaactgagacatagagagtcatttaatcggtgatgtgtgtatgagctgaaaagttggaaagagtttgggctggtctggccatattagacatatatcagatgcataggcaaagcaaactacgagagagagagagagagagatcaagactgagagagagaccaagatggctttagacagagggagggagagagaatgagagagagagagagacactgagagagagaaagacagagaccaagctgacgttagacgtaggtgagacaataatatccagggattaatccaaatttccagccttttttcttttctcttcctagcttttttacttgaggcctgtctgaatgtaattttgggttctcagattcattggaatgctttatccctttgcatccttaaataaaactcctttaactcaagctttttgaagcaggtttcttttcagtgcaaccgggaaagctttgattagcacaaggattctactcactgtgttctcagttccacatagcaaagtggctacttttagtaggctcggtaaatattggatgagtgaactaacagtaggcactaaagatgctgcagggcacccagaaaattattctgtagagtcaaaacctgaaaggcatagggttgtgtgaggaagagagggaactgactacagaggcatgaagctactatttggagtgatggaaatgttctatatcttgattctagtgataattccatgactctatgtgcttatcaaaatgcacagaactctacattgaaaaaggtgacttttactgtatgtaaattttaacttaataaacttaacctaataaagaagcaataaaaaagaaaaaaacgcaaagtaaaataatattttctctacaacacattaatttcctaatcaaaaatctttaactttttttgcatcattttacccaattctttttcttttttcctgggaccataggatccagataatagaaatgttgattatgggacatgatattgctttttgacttgcttgacattattcaaaaatgttgccaaaatagaaagtactatttctctactttccagttctgagtactgataaaagcaaaatattatgttcagaaagaaataagcccgtatttctgagctccagcttctgctaggtccccatttaatgttgttgcctaactactaactatttgatttgaaagctttaaacaatattgattatactctcctgagcaggcatctctcagacttaaacattgcttcataggatatttaaacacgccaattgaaaacaataataacaatgacaatttatgaaggttgcattcccaaatgtatttgagaaattctagtttaagaaaagtgaacatgtttctttatttcaagacttcccgatgtcttagaatagtcagacatcaaatttcatccacagtttccagagttgctatttctttcccatacctttgctttggaacttgatctaatggaattgttactgttactatgacatttttcatgtgtactatgtcctaaaaacactgtggttgcattcattttattttatttttgagagatgaatctagggcctcttgaactttttattcgtagttatgctgagtactagcttactttaaaaataagtctccagtacttgtgaggaagactcattgtcagagcatgaaagatttttctgccttttgttttgacttctaagatacgtttctttattaaggaatagttttatgctttgcagaagatgcattgtaccataaaaaccagtaaaatctgtgcattaaaaaaaatacctggatttaaaccagttacttggcattctgtgaaggtaaaggaatacatttttaccttaaatgatagtgtttatattttgttcacacagaaaaaaacaaaataaaaacaagcaactcttagtgattctgcatatagttatagtggttgtggacctttaaatattctccatcagttatgttttttaaaagcagaattttgtaaactttactaaattcaagctgctctcctgtctgcgatggctgaggacattggaagaatacttctgtacttttccatgacagccagtgtcacctcctggaagcaatcattcgtagattacttataaattttactcctagaatagcaatggtcactttagacaaatgaaatcatgcaaagagctggtatcaatttcccacctatacccactttcacccaagtcaggagggggcaatgtggaacttggtgtgggtccaagtcctaagtgaattattcctagtatagcccgttgaaatggcaaataaatggccacttagagaatgtttgagtgaaacaaattggtcgtctgttatttttaggctacttattcataaaatccaagctatattatctctggcctcatgatgctctaaataattttctgttgtagaacccatatgcttatggttatccaagagcttctaaaatctactttggtaagatgaggaaatattttatatagtatacaaaccctgtattttatatagcatacaaaccctgtagcctaaccgtcctgccatcttaattgtacagtttgctgctataattattaatagattgtaaattaggaacatctggccaattattagaaacacaaaaataaatcatgaaattgatatgagagcctaaagtgatgaccatcaaaaaggcaggcaggaatattttgtatttggtccttcacaggtaaataatttaatgcctgcctaatataatcagttacctttcttgtaaatttaattctttgatctccatttccttttgtagcagcaatttccaacataaatttcagcagcagaaaaagaatcaggaccctataatataaagcaactgtttttttgctttataatgtatttatgtggatcatcattctcatttctggtttctatatagtctaaaaggcaaggatagttcccctccccaagatatgggccattttatggattatataataaatgggctctaaaggtaaattgttattattcaaaaccagctggtcaggcaggcaaggcagcttagatacagtgaattctgttttgctctagtggaaaatgtcatgctgacaaggtcagtgctgggaactggtgtcatccagaagcaggcatgcagcacctggggaaggctgagaaggaggcccctgctctgtttgctgttggtcaaatgagtgccagaaatgcagggcttcagcagcacctagaagtccaggtttagcagtaggtttgggggctcacataatctgtactagtgattgttattgttaatcacataattactagtgtgttgttagagcatattgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagctattaaatataattccaaatattgtagatactaaaaagagttcattctagtgcataaattttttctttttactgatacagaatatttgtgcatatattgatgttcatgtgatgttttatgcatagaatgtctagtgatcaagtcaaggtatttaggatatctgccctcatgtgccttataattttatgtgttgagaacattcgagtcctcatttctagctattttgaaatgtacaataaattgtcactaaatttagtaaccctactccactaccaaacatcagaacttatcccttttacctaactgtatgtttctacccattaaccaacctctcttccttatccccctaacccccgccacatatacccacattcttcccagcctctgataactattcttctactctctaccttcatgaattcaatttttttagttcccacattggaatgagtacatgcgatatttgtctttcagtttgtaggttattttatttaatgtaatgaccttcagttacatccttgctactgcaagtgacaggattttattctttttttatggcagaataatattccattgtgtaattccattgggtaaatatatcacatattctttattcattcatctgttgacagacattgaggttgattttttatctttgctattgtgaatagaaacatgggggtgcatgtatcccttttatatattgattccctttcctttgggtaaatactcagcagtgggattgctggattgtacagtagttctatttttaggttttctgagaaatctctttactattttccctaatggctgttctaatttacattcccatcaatagtgtatgaaagttcccttttatctgcgtccttgccagcacatttgttattttttgtctttttgataatagctattctaattggggtaagaagtgatctcattgtggttttgatttgcatttccctgataattagtgatgttgagcattttttcatattaccccttggtatgtctttttttgagaaatgtctgtctttatcctttgtccacttaaaaaaaaaaacttttaggttcaggggtacatgtgaaggtttgttacataggtaaacttgtgtcatgggggtttgttgtacagatttatctcatcacccaggtattaagcccagtacccaatagttatcttttctgcttctctccctcctcccaccctccaccctcaagtaggcctcagtgtctgttgttttattctttgtgttcataagttcttatcatttagttcccactttataagcgagaacatgcagtatttggtttcctgttcctgtgttagtttgctagaataatggcctccagctccatccatgttcctgcaaaagacatgatctcattactttttatggctgtatagtattccgtggtgtatatataccatgttttctttatccagtctaccactgatggacagttaggttgattccatgtctttgctattgtgaatagagctgcagtaaacatttgtgtgcatatgtctttatggtagaatgatttatattcctttgggtatatatccagtaatggattgttgggttgaatggtagttctgcttttagctatttaaggaataaccatactgctttccacaatcactgaaataatttacactcccaccaacagtgtataagtgttttgttttctccacaaccttgccagcatctgttatttgactttttaataatagacattctgactggtgagagatggtatcacattgtggttttgatttgcatttctttaatgatcagtgatgttgagctttttttcatatgattattggctgcacatatgtcttattttgaaaagtgtctgtttatgtcctttgtccactttttagtggggttgtttttttttctcttataaatttgtttaaatttcttatagatgctacatattgaccttggttaaatgtgtagtttgcaaatattttctcccattctctaggttgtatgcttactctgctgatagtttcttttgccgtgcggaagctcttaagtttaattagatcccacttgtcaatttttgcttttgtggcaattttgccatgaaatttttgccatgaaattttgtcatgaaatttttgcttgtttctgtgtccaggatggtgttgcctaggttgtcttctggggtttttatagttgggtttttacatttaagtctgtaatctatcttgaattgaattttgtatatggtgtaaggaaggggtccagcttcagtcttctgcatttggctaatcagttatcccagcaccatttattgaatagggaatcttttccccattgcttggttttgtcggctttgtcaaagatcagatggtcataggtgtgcggccttatttctgggctctccattctgttccattggtctgtgtacctgtttttgtatcagtactatgctgttttggttactgtagccctgtagtatagtttaaagtttagtaatatgatgcctccagttttgttctttttgcttaggagtgccttggctatttgggctcttttttagtaccatatgaatttttaaatactttttcctagttccgtgaagaatgtcatttgtaatttgataggaatagcattgattatataaattgctttgagcagtatggccattttaatcatattgattctttctatccatgagcatgggatgtttttccatttatttgtgtcttctctgatttctttgagcagtgttttgtaattctcactgtagagatctttcacttccctggttaactgtattcccaggtattttattctttttgtggcaattgtgaatgggattgtttttctcatttggctctcaggttggctgttgtcagaattctcctcccaaaaacaatatatattcttctcattgtctaatggcatgtactctaatattgaccacataattggacataaaacaatcctcagcaaatgcaaaagaaccaaaatcacaccaaacacactcttggaccacagtgcaataaaaataggattcaagactaagcaaattgctcaaaatcatgtttatattcctgaatgacttttgggtaaataatgaaattaagggagaaatcaagttttttgaaactactgagaacaaagatgcaacacaccagagtctctgggacacagctaaggcagttaagggagaaattaatagcactaaatgcccacgtcaaaaagttaaaaagacctcatattaacaacctaatgtcacaactgaaataattagagaagcaagaacaagtcaaccccaaagctagcagaagctgaactgaaggaaattgagacacacaaaaaaagcattcaaaagatcaatgaatccaggagttggttttttaaaaaaattaataagataggccactagctagactaataagaaaagagagaagatccaaataaacacaattagaaatgatgacgggaatgttaccactgaccccacagaaataaaaataaccatcagaaactactacaaatacctctatgcccactttttaatggaattttttgttgttgtttgagttccttgtgtattctggatattagccccttgtcagatgaatattttgcaaatattttctcccattcaacatgttgtatcttcactctgctgattatttcctttgccatgcagctttttagttaatatcttcccatttgtctacttttgttgtcaattttgcctgtgctttgagggttttagtcataaaatctttgcctagaccagtgtcctggagtgtttcacctatgttttcttctagtagttttatagtttggggtcttaaatttaagtctttaatccattttgatttgatttttgtgtatgttgagagatagggttctagtttcgttcttctgcatatagataaccaattttcccagcaccacttattggaaaaggtgacctttctcactgaatgttcttagcacctttgtcaaacatcagttggctgtaaatatgtaggtttactttgggtttatctttattctgttccattgatctacatgtttgtttttataccaatacgatgctctcattgttactatagccttgtagtatattttaaagtcaggcagtgtgaagcccctagctttgttcattttgcctaggatttctttggcttttcaggctcttttttggtttcacataaattttagggtttttttttctaattctgtgaaaaatgtcatcatattttaatagggatgcattgactctgtagattactttgattagcatgatcatttaaacaatattaatgcttccaatccccaggccttgggtagcgtgctagagtgggtgcagtagcagtgcagtgagtggggaaagcctattcttaaagtgcatgcaaacacagagctgttgaggggtcagggttgctatcggtgatagccacctcaggcaggcaggtttgaggctctgaggagtacatactttggctcccctttccccagcatgcagatcactgtgtgggctagagttctggggactctgtttttccagtgaatccaagtagcatttcaccattgcagtcctctgggtggactcagggggatgccagtggtgtgctcccaagaggcagagatgcagaggctgttgtaccctgggctaggatgcagtttggtggggctgggctctcaaaatcgtgctgtgctgccgctgcctggaactttaggaatgtgtgggacccagcgtgagctccttctctagggcaatgatattgtatagactctgggagctctctacttcagtctcaaggagagtcaagggactctcctgtggctagggttataggagcctaaggtgagaatgtggactgctggagatccctcttatccatttcccatgctggggaacctatcaaggctctcaggggatcccagctgggctgtcacttgcctgcttctccttcattgcctcaggtgtttcctgtgacttctttacttatatgttctatttaaagtgtgactatctacttgctatttttgttctttttgcagaagttcgtgtcctgtacctctggtcagccatcttgaacctctcccctatagtgtttaaattttatgatgctctttcctgttagaatatctccttttgctcttaactgtggttatgggacatacctttttggtcttttggtcctttgtaaaccccatacagactggctaattcctgaaaccagctgctgtaaagctacaagccactaataacaatcataattgtctcttcctagattggaagattctggtcagttaattgtgtgggttaaatatcagaaggctagaggtgagcagtagtacctctggttgaaattggcagtttatattggcactttctggttgaaagtagcacattatatttggattcctgggttattcttgatacatttggataagttgcatactgattctgaatgagtgaataggtggatgagtgagtgcaaagatgcatacatgtacatcactgtgcattattgtaacaatacattggcttctcagttttccaagaatccctttgtcccatagctgagcagctcttatgaattcttcacacatatatgctacttctagtcctttccataagtagaactccatggaacaaataccaaaacaatgactactctacagttcctttctgatctaggctggagaatgtttgtgtcagatgtctatccctttaaagctggggggaagaaactgaaagagaggtgcagaggaaatgcctctaattatgggaccaatttaatttaaatgtccaaatgagcaccctatatgcaccaatccttggatagggcagtgaatcaaacatggactttcaagggttccagagtctgatagcaaagacagatatgtaaatatcattatcagttaaactgtatgacattccctatattcaaatgttttgacctaccaaaagcagcagtctctcatggttcagctcaatacatgtcagtatgacagctaagataatagaggtgtgtgtacatccagcaggggtgcagagaggggagaggcaggcagagtgaggactctggaaattttttcaggagttaagacctacaaagcattttggtgaatgatggggaaaatagggagaaaaggaaagggagcgaatgaaaattttggaaaatataaaagaatgtatttcctgaggagagtggcctacattgttaaatttgattttgtttttatgtttaaatatttaaaacataccaaaaagcttaaaaaatagtatgacctcccacatattcaaaataacgttttgagaaaaaggaatttgcacatttgcttaaattcctttttcttcataaatcaaatgtaataagggtaacaccactatctatcctacttgtctctctcctttcctatagatgaccatcacaataaaattggtgtgtatttttcttatgcattttaaaaaactttcattgcatatgcatatatttataatatagagtatggtttgattgttttaaaatgttatataaactgtctcatactgtacatatccaattgcatcttgcttttgagttgctaaacatcatgttttgaaaacttatccatgttgatgcatgcagatctagtttattcagtttacctgctgcatagcattctgttattggactatatcatactttatctattaatagctatgttcttactgatgggtgggcatctacattgttattacaatacaaataatactctacttgtcttcttgtggacaagggtgaagatttctctggaggacatttccagaagtagaattttgatgtcagcttaatcagatattaacaactcgcattccaaagggttttttttgtctttattaatttataggtacatcttatatattcaggatactaacattttatattttatgtgttgcaaatatcttctgtcagtctgtgaccttttttttttttgggagacagagtcttgctctgttgcccaggctggagtgcagtggcacaatctcggcccctctgcctcccaggttcaagtgattctcctgcctcagcttcccaagtagctgggactacaggcatgtgccactatgcccagctaatttttgtatttttttagtagagatggtgtttcaccatatgttggccaggctggtctcaaactcctgaccttaggtaatccgcctcccttgtcctctcaaagtgctgggattacaggcgtgagccaccgtgctcagctgtgacctatcttttgactttatggtatttattattgtgcaaaaacttttaagtttaatgtcaaatttctcgatctttttatttttgggtatgcttttcatgttatagaaatcattatttatgtgaaagtcataatgttgtatttttttttttttacaagttttaaaggtttgcttttctcacttaaggtctttaattcatctggaattttaggtttatatacataatatgagggagaaacctaagtctttcttacatgaaaagccaattgttccaatatcatttactgattaatgttttaccaactgatttatcatgtcatgtctaccatatatctagatcccacctatatgtggatctatttctggtctctgttttgttccattaatctgtttgacaatccttgtgtgaataccacacaatttgaattattgtgctttgataataatttttgatattataaagcagaccccttttaataagccacatcatgaagtgtggtccaggtttgaggatgggtaagcagaacttccaaagcagccaaagcaatgtaaaggaaatggacaggtttctccgttgctctgttttatctcattgaactatatctgatgttcacagttcttggtagtcctaacagagtaagatgccttctacatctgattaacctaaagctgggggcatgaatatatgtcaataattctacactgatcttggggtcttgcttgctgggagtactggggcagttggtttccatctgtacctgtaccacatgatgtaggaagtttcccatttatatctatttagaggctttcctggattatatctagtcatggttgctatattctttctccttttccccttccttctcaaaaattattatgactaatcttggcttttaatttttttatataaaatttaggaacagtatgtcaagttccgtcttactgggagttatctggaattgcatagagtaatttaggaagaatcaacttttttgaggtattagtcttcccatgtgtcaaaatgccatagaccttctttaacttaggtcttcttttctgtcctccagttaagttgtttttgttcgtattttttcattttatttttttattgggtaaaaaataaacataaaatgtatcatctttaccatttttaagtatagagttcagtggtaataactacatttatatttcttttttcctcttcatccctccctccctgctacccttcctggcctctggtaaccattaatttactctctgtctttatgagatccacttttttgagctcccacatatgaatgaaaacatgaggtatttgtctttctgtgcatggcttttttcatttaacacaatggcctccagttctatccatgttgctgccagtgacaggatttcattctgtttatggctgaataatattccattgtgtatgtctaccacattttctttaccaattcatccattgatgagcacttagcttgattccatagtttggctattgtgaatagtgatgcaataaagatgggggtgcatgtatctcttttatatactgatttcctttcctttggatatatacccagtagtggaatagctggatcatatggtagttctacttttagttttttgaggaacctccatactggtctccatagtggctgtactaatttgcattcccaccaacagggtatcagggttctcttttcttcacatcctcacctacatctgttattgcctttttttttttccatgtaagctattttaactgagatgaggtgatatatcattgtggttttgatttgcatttccctgttgattactgatgttgagcatgttttcatatgcttcttggccatttgtatgtcttattttgagaagtgtctcttcatatgttttctccatttttaaattgtagtatttggttttttgctattgatttgtttgagctccttatatattctggttattaattctttttcagatgaatagtttacaaatattttctcctattatgtgggttgtttcttcaatttcctttgatttgcagaagatttttagcttgatataatcccatttgtttatttttgctttggttgcctgtgcttatgatgtcttacataaaaaaaaactttgcccagattaatgtcctagagcaattttcccaatgttttcttctagtagtttcattgtttcaagtctcagatttaattattcaatccattttgatttgacttttgtgtatggagagagactggggtctagtttcattcttctacatatagttatcctgttttccctgcaccatttgaaaagaccgtcctttccccattgtatgttcttggtacctttgtcaaagatgagctgattgtaaatacattgatttatatttgggttctctattctgttccatttgtctatgtgtccatttttatgccagtaccgtactgttttggttgctatagatttgtagtaaattttgaagtcagagagtgtggtgcctccagcttcgctctttttgctcaggactgatttgtctttttggggtcttttgtggtttcacataaattttaggttttttttttttctatttctgtgaagaatgtcattggtattctaatagggacttcattgaatctgtaaattgctttgagtagtgttgtcattttgacaatattaattattccaatccatgagcagggagtatctttccatgtttttggtatcctcttcgatttctttcatccaagttttatagttttcattgtatagatctttcacttctttagttagattgattcctaggtatttcatattttttgcagctattataaatgggattgctttcttgatttttttgtttgctcttggcatatataaatgctgctgatttttgtgtgttgattttgtatcctgcaactttactgaatttgtttattagatataacagtttttttggtggaatctttaggtttttctagatatgaaatcatgtggtctacaaacaaagctaatttgacttcttcctttctgctttagatgccctttttttcgttctttcctaattgctctggcagggacttccagtgttgtattgaataagagaagtgaaagtgggcatccttgtcttgttccattccttagaggaaaagctgaaagctttttagtacaatgttaattgtgggtttgtcatacatagcctttatcatgttgaggtatgttccttccatactcattttgatgagggtttttatataaagcaatgttgaattttatcaaatgtttttcagcatctattgaaacaatcagttggtttttgttctcaattctgttcgtgtgttgtattacatttattaatttgactatgttgaaccatctttgcatttctggggtgaatcccacttgatcatagtgagtgacctttttaatgtgttgttgagtttggtttgctagtgttctgttgagcatttttgtacatatgttcatcagtgatatcagcctgtcatttttgttgtttgttgtgtccttgtctgtttttggtatcaaggtgatgctgtccttgtagaatagttgggaagtactcccttgtcttcaatttttttgaagacaaagaatttgagtaagattgttactggttattctttaaatgtttggtagaatttatcagtgaaaccatcaggtgctggacttttctttgatgggaaactttattacagccttcttctcattaacaattattggttttgtgaggttttctatttcttcatggttcaattttgataggttctatgattccgggagtttatccattcttccaggttttccaattcgttggcatttagttgttcataaccatctctgatgactctgtatttatgaggtctcagttttaatgtcttttttttcatttctgactttatttatttgggtattctctcttttttcttagtctagctaaaggtttgtcaatttttttatcttttcaaaaacaaacttttcatttccttgacgttttgtggttttttagtctcaatttcatttatttttgctctgatctttattatttctttccttttactaatttggggtttggttcattctttctagttccttgaggggtgtcattaggttgtttatttgaagtctttctactccttttgattataggcatttactgctatacatttccctcttagtgttgctgttaccgtatcccatagatttgggtatgatgtatttccatttttgtgtgtttcaagaaattttaaaatttccttcttaatttcattgacccattggtcattcaggaacacattgtttaatttgtatgtgtttgtgtgttttccaaagttcctcctgttactgatttctagttgtattccattgtgatccattgtgatcagaaaatatacctgatgtaatttatattttttgaatttgttcagagttgttttttggcctaagctgtgattcattctggaaaatgtcctgtgtgctgataaaaagaatatgtattttgcagcagttgggcctattagatttagtgtggagtttaactctactttttctttgttgattttctctctgggtgatctttacattactgagaatggggtgctaaagttccctaccattattgtactgcaatctatctctccctttagatctgttaatttttcctttatatacttgagagctccactgttgggtgcatatatacttacaattgttatattctcttgctgaattgacccttttatcattatatagttaccttctttgtttctttttacaaccttagatttgtagtctattttatctgaaataagtatagctatttctgctttctttttagcttccagctgcataggatacatttttctaccccttcattttcagtctatgtgtatctttatatgtgaagtaggtttcttcaaggcagcatataattggatcttgtttctgtcccttcagccactctctaacttttagttggagaattcagactttttacgttcagtgttattattgataagtaaagacttattattgccattttgttgcctgttttatggttgttttgagactcctctcttcctttcttcctgtcttcctttgtggttattttcactgatagtatgttttactcttttgctttttattcttagtgaatctattataggcattcatgctgtggttaccatgaggcttacaaaaaaaaaaaagaacttgtagatataacaggttactttaaagagaagaaaagttattttggatcacaaataaaataatagaaacaaacaaaggtggccaggtatagtggctcatgcctgtaatcccagcactttgggaggctgaggtgggtggatcacctgagtcaggagttcgagaccagcctggccaacatggtgaaaccccgtctctactaaaaatacaaaaattagccaggcatggtgatgggcacctgtaatctcagctactcgggaggctgaggcaggagaattgctggaacctgggaggcagaagctgcagtgagccgagatcacaccattgcactccagcctgggccaacaacagtgagactccatttgaaaaaaagaaacaaacaaacaaaaaaccaaagttaaaggaccacaagacaatctacgctttaactgcatcccccccaaattttgacttttagttgtctcagtttacatagttttatattacttgtctctcaacaggttgctgtaactattattgtttttgatagatttgtctttttggcttcatactagagttatgagtggattgcacaccaaaatttacggtaatagaatattctgggtttgtccatgcaattacttttaccagtggtttttataccctgaagatttttctttttgcatggtagtgtttttcttcttttagatagaataactccctttataatttcttgtaaaatatgtgtggtggtgaattctctcagcttttatttgcctgggaaagattttatctctatttcatattcaaaggataattttgctgggcatagtattcttggatgacaggttttttttattttcttaaagcactttgaaaatgccattttttcccttcctggcctgtatggtttccgttgaaaagcctgttgccagacaaattggagatcctttatatcttatttccttcttatctcttgctgcatttaggatcttcactttgtccttgacctttaagattttgattattatatgctttggattagtcttttttgggttgaatctgtttggtgttctttgaccttcctgtacctggatatttatacctttctcacattttggaaaattttctgttacttctttgaataagctttctaccccttgctcctactcacttccctcttgtacatcaataattcttagatttggtcttttgagataattttctgcatcttgtagttggttttctttccttttcactcttcttttttctctgactgtgtattttcaaataatcttcaagctcactgattttttttctctgtttggtccattctgctattgagagtctctaatgagttcatttcagcaaatgtatttctcagttccaaggtttctatttgatttctaaaattattttaatatctttgttaaatttctctgataaatttctgaattacttttctgtgttaccttggagatcactgcatttccttaaaactgcaattttgaattcctggtcagagagcttacaaatggctgtctcattaggtcagtcactggatttttgctttgtctttttggggaggtaatgggtctgtttgctgttgtttcttatgggtaaatgtctatgtctttgaaggactagctatttattccagttttctctgtccagcttgttttggtttttattagatatatttgcttagtatatctttatcacaaggttgcggtttcctttttgcctctaggtggtaccttaagcccaggtccgcgttagctctagtaaatgatctgagccctgcctgtttcaaatgtggagatcccaaagggattatccaaccagtgtgggaaggctgggtaggggttcatgttcaaaagacctctgaattgtaccttctacaatgtgatgctgctgaacagccactctgatttggcatcttctttagccaagttacagtacagtttccaggaatgagtatggtagtcctgcctcccacctttgtctttgcaggcagtatgatgcttccagtgggtagaggcaagtacagaactcctgccagggaatccaagctggtgggaaagctgatttaccacctcaatctcacatttttccagtgtagaaattgtgagttggggaaagattttccacacacttgttgcagggcaccatgagggggagaggcctcaaggatttggaagtccaactctttcactgttgacttggagttttttcacctctctgtggccccaggatgcatctcatcctcatatttgacttctgggttgttgctggtgaaaatcttggcactgtatatttggttttggttttctgtggggggaaatgaagctagattgtttctgcactgccatttgaaaactggaactcttccagttaagttttatactttttccataaaagtttggcacattagaaaagatttatttttggatacttactttttgttactatataagtgatatttttgcttgttctaatgtttattctaattagttctactgcttatttcttatattatgttgaataaagtggtgacaatgggcatctgtctcacttcccactttaagagaatgcttccaatgttttcacagatattttttggtggtaatactctgtcagattataaatttttatggaattgctttctcaacctcttctctgtctgcaatctccgtggtactgtctggcttcctgcaattccccttttcagtcttccagccaaaaatctaagatttatttggtctgctttgctacacactttttatgactgcaattgtgtctgagaccaagtggctggaggatagagaaagagaagcagtagggattcacctcaccttttgagaccacagctcccctgattgaaaggaaatttccctttctttagagttttagctgacagttgctactgtaccaaagaagccttttttttttatacttctagagcccaaactagaggtattctgcatgagcttttctctgcccatgtcaatatccacttcttggtttcaggatgccttgagaccaggctaagggatatggagggaaaaaaatgataaattcaccactggttgggtgattcttagaatttcgttcttttttttccctgttcacctgctcctatttacttctcagaatcctcaaataactgctccatgcattctgttcaaattttgtagcttcattcaataggagagacaaggcagagtttatctgtttcgtcttacctagaacagaacctactgatctttttaaacaaacagtttttggctcaatcaactttattctttctttgtttcttttctatttaatttctgttcttaaaaacaaaattctccatatactgttctctttgggcttatcttgctgtttctctaccaccaatcttgagttgcagacagcccaatttttggtttttcccctcataatatatagataaaataatatattataaaatttattctaaaaactaatttggatatatttattttcattttaagttagttctaattagttcctagtttctatttttgtagttttctttgactcaaaaatataagtttcaaacaaatagcttgctatatttttgaagattgatttctaattttattttactgtggttatatactgtgatttgtgtgaattcaattttatattatttattaaaaatttgtgatccagttcatgttcaatttttgaattaatgtatgcttggaaggaatgtgtaccctttaattgtgagtggcaaggttcaacatatcaccatcaaattaaacttattaaaaattctcatactcattgaaactaccctgtatgatactatagtggtaaatatatgtcattataaatttgtctaaacccatagaatgtacaacaccaagattgaactttaagataaactatggactttgagtgatagtgatgtgtcaatgtaggttcagttgtaccactctggtggaagatattgagaatgggggaaggctatgcacatataaagtaggggatatatgagaaattgctgtaccttctgctcaatttttctgaaaaactaaaattactctaaaaaataaagtgtattaaacataattctcaccatgctgattgttaattaattcatttctccttgtaattctttcaatttttaaaagtacagaactattattactgatgaatggttacctttgtcattatacagtcttattttagttttactataactaaatttttgttagtatttgtcttatatcttattaaatctccctcctttcaatgttgatgagccattatgcttcaagtgtatcttgtaaatgacatgtatttggatttaaaaaaaaattatcctgagactttctaatgggctagtttattctgtttatactcattatttctgatatttttggattcatttataccatttaattttattttctatttatgatccttttctttttgtgtatattctattgtattgattttctttattgtttctcttttcccccatctatcattttgaaactatataattgatttatattattttagtggattcccttaaatttttaatatactatattgatttaacgaggtaaaaagaatctctatctttacctatttgctaaagaatatatgggacttaaaaagctttaactctagaaatctctcaattcatccatgtattctatttatatcttatttttaacatcccctgctcccaaattagtcattactattatcatttaaaatagatgtatccatgttgagccaactgtctttgttccatatagttttttgtataatattgtttcatttaggatcaaagtacaaccttaaatagttctttcagagtctttgagtaatcaactctctaagtctttgcctttgtaaaaatatctttatttcttctttattataagacatatttactgttggaaaataacttagctgggtatagaattccatgttgagaattattttctcttggtatgttgaatatgttattccataaagtgctggctatcttctccaagtcttctctacctgaagcccactctggacctgctaagccagtagagtgcacctttttcaggggtcctaaacctgtagcagcctactgaaaatcatataactttctccctagaaaaatggataaaataatgcctactaatttgagagttacagatgctcttacgctcatcttagccttcagtttaagaacacttgtaatagggctttcaaaggtggaagatctttcccagtgagagacaggccctacatctttccatgtacaactttggccctaaagttcccaccctgatgagcagagtgatggatcatgcgctgagagagctgcttttgtctttccaacctaaggcttagctgaaagagacagtaatggagacaagaagcttatccaatgtgaaataaattgctaaacagctatctgtgtagaagctggaggtgaaatacaagttgctattctgtccgtataaccattggtggttagtggtacagctacactcacatggtacaccacaagaggggtattcaaacagacttatcaacaggaattatttagacgtctccatgtcaattcagtcaatagaaggttcttgttaaccaggcattggagactacaaaataacattgtgtgagattaggaagaggctacagaactgagcagaatcttgcaatggggaggtatgggggtcttcatgggtcataagcccactctttattgcccaaaggagagcaaaacctttttaccagctgacctctgtattagtctgttctcacattgctgtaaaaaaatacctgaatctaggcaatttataaagaagagaggtttaattagcttgcagttccacaggctgtaaaggaagcatagcagcttctgcttctgaggaggcttcaaaaaacttacaatcatggtggaaggtgaacagaaaggagacatgtcttatatagccagagtggggacaaaagagagagtggggaggtctacacacttttaaacaaccacatgtcattagaacttactcttgcgatgacagcatcaaaggaggttggtgttaagccatgacaaaccgcacccatgatccaatcgcctcccaccaggccccacctccaacattggggattacatttcagcatgagatttgggtgggtacacagatccgaaccatattaatctccttcacatattgaataaggttatgaataggtaagaaccatgtgagaaattcacaagaagatgtacaattttttgatcttcaataaacttttatttaacatctgttgtgactgaggtatgccactaggtgctgggatgtaagagctcaccttagaaaaagattttttccccccaataccccttccatattttataggcctgaaaaacaaaacatacccgctcccaatggccaccccctcccccaatgacatgcacccacagacagttaaggatgtgtgggtatttgtataccttgtaaaaagagttgagctaaattatagctccccatttaaaaaacagtggtagtctaaagctgcagagtgcaaaattcagagattgccatagtaactctgcttttcccaggaagtaattgaaaaaaggcacattttataaaaatagaatattgatgttcatatctataaaggaattaatttactgactgatagaggggaaagaagaaagatgagccattgagctgcattttaatgtgattgcgattatccccagggtggcaagcagcttaaactcgttcttttatttttgcagcaaagagcacttttcttttcagcttggtttgtgtatagaaatagtttccagaaatatatagagtaataaggaattagagagcacatttagtaaaacactgaaaggctccaatttgtttcttgccattatcagtctgatgaatgttaaaattgcttggagtatatttaatcactgttcatgattagtacagcagcgatactataggaatagctgcaaatgtaccattagcaattagggaattctggtctatcacaggtgccatcatgagaccaaagacaaacacatgaatgaaaaatgattaggctaggaaataataatgatgataatcatattctagaaatactatttagagggttgacaggattttgatgaagacttatatatgtgtatatttttatatatgtggtgtaaatatatgacataaatattccagggcctgttctctggaaattttcttctagagaattagaattattctcaaggtaatttttttaaatttcccaatcacatcccagctggctaaaaaatgatccagttgaaagcatctcagatggtgaactcttaggccttatggcaggaatggggaggagagtttgaggagagagccctccctagagaccagtgagatcacacccctggtaagattggttctagctggcaggaagtgagaataatgtggtttttctctcagaacaattcttaaactaaaggactagaactttaaaagttgaatttcaggctgggtgcagtggctcatgcctgtaatcccaacactttgggaggccgaggtgggtggatcatgaggtcaggagttcacaaccagcctggccaagatggtgaaaccttgtctctactaaaaatacaaaaattagcctggtgtgctggcggggacctgtaatcccagctactcaggaggctgagacagagaattgcttgaacctgggaggcagagcttgcagtgagccgagatcacgccactgctctgcactccagcctcggtgacagagcaagactctgtctcaaaaaaaaaaaaaaaaaaagaatttcaagcatagataccctggcatgggagttttggatggatggagttttggagaggctgcactgggctctatttaggatttatatctgtaatcatacaccatataatgatgttttggttaatgacagaccacatatatgacagtggtcccttaagcttataataccatatttctactgtaccttttctatgtttagatacataaatactattgtgttaaaattgcctataatattcagtagagtaacatgctttacaggtccatgggctaggaggaataggctatatgatatagcctaggtgtgtggtaggctaggtttgtgtaagtatattctatgatgttcacacaaggacagaattgcctaatcatgcatttctcagaatgtatgcctatctttaagtgatgcatgactgtattatgatatttcttatgctttggaacaacactactatttttcatttatctattgcttcccctactaggatatgagctcacagaaggagggaaggatagtgtcttaataatctctgaggtcataggcctggcacagttcctggaatagagagacagagtggtaaataaatgcctgattgattgattaaatgaatgaattcagtgaggcagacttacatcctcttttttagggccatccttgctccctggacattgccactggcttgtctgatatcacagtcaccttcactgctgccatgatccttgatagaattttacaataaatttcttttctaaaaatgaaatttcttttttttttagaagaaatgaaaagagccaatatttattgaatacttgctataagccaggcactggcctgagtactttatatgtcactatgtacctttaatcttttccaaaagcctggtagagtattattaatatccccacttttcagaaagggaaactgaggtccagaaagaataagtaacttggctgagattttgtaactggcaaatggcagggccagaattagaaatcgagcagtctagctttcattattttcccctttgttctcaggacactgagtataaatggaaataaacccaattcttagatgtcagaaattagggtaaagatattttcatcgtgggcaagggcagtaagaaacaaagatgcattgctagatcacaggaataattatgtggggtctttgataaaatctgaaaacctagaaagcattttccaagtattagaaagcattcatgtttacattgttggaatgagattgtagcatcgcagtgtaagaaaggccttggataattctcgatggtgtgccacttaatgataactcactattgttttgagcttgcagcttttaaaaatactttcatgtcttgctttgtttgatcctcacacccgctctgagatattcagtgccgatagggcagacattagagatgctcagtattctggctttcttctttgggcacagggtagattgtacttacctgtacctttgaaattgggtctgactatatgagctgctttggccaaagaaatgtgagtggaaataacacatgacatttctaggtgaaagcctttgaaaagtgactcaccatgttctctttttccctgctacaatgatgagctatgttctggatagtgcaagttcatatgcttgtgtgtttagaggactgatatggaggaaggcctatatgcaaattatgactccattattttaatatcaatacctcttatatttctgattttctaaatccttattatagtgcatatattatctgaatctctgaccccaaacacgtgtccctctggggagtaatgtggatagcactggtctccctaggaggctggtaatgaggcacgagggcatttggtgcctggataaaggtggcagaataaggagcttagtattatagatacaaggatacctatttctccttttctcttcatttttgggctttgaaaattagacaatcaagcattataggaaacaacaacagtatccaactcagaattcctgctggctattttcaccttggcacatccagtctgcaaccagcttcaagtgctcatgaaacagacatcagagtatttttctactttttgaaacctaccacattacatcttaagtgacttacttgataagacttatatttagggtttttttgtctgtttgtttttattttcccccatctcaaaattagctaagcatgaagatgaaacagatttctgtatgaagactaaaatctcaggaagaggtgctgaattacaaagggagtttagttagttagttgatgaaccatggtgggtgccagcatgtaggcacatcagattttacaggctacatctttgtgtcttgcctgttgagaaggcatcccagcccaggatatatcctccaaaaggaaagggaattggactctaactgggcagcaatgagaataatttctttgaatgttacaccatttacttgtcagtgtgtggtgagcactcagcttgactgtaatgaccacaggatcctgagttatctgcaccagctgctcaaccatgttttattttggtgatcgaaatcctagttaaaagtatcctagttgactaatgaaggtattctaaacttacataagtaactgagtcctagcaatatattcaaatgtcaaatttagggatgttgacattttagattactttatacatcaaatgatttatctgaaatcaggaaacaaccacttataatacctcagattgtatcgataatagttttagatcactctatttttatacatttctgggcacaaaacatgatcaaaataatgtgggatgtaactaaaacatttctctccattcacactcttctactacattaaatttatgtttaaaatggctggaaggtgaaagaggcagaatcctttaaggagaatgcccttagccagaatcccagcttccatcaagcaaaacaaaacaatggctgggagtagatgggtgtttaatgactaaaatcttcaataatatatgggcaataacaaataatagtgatcatgagaaattgtttcctgattgtgtgatacacagtcatgtgcagggtggcagtgacgacacgtggtccagtatttcatggcctttttttgtgtaacagtatgtgcaaggtgagaaagcctacaggaaacgagcgacatagagcggccacataggcaaagtggaggctttttttttttttttttttttttttaggaggctggattttccttctcagtcactggcttgataattagagccagcagcaggaggcaaattaaagccttattggaaaattctaaataggtaggtgtttgtgggttttggatatttctccaaagccctgaagcaagactgaaatgtgggagcaggcataagcacgtcttcccaccaagccagatacatcctttagcagctctcaaagttcttaaaaaccataatgctgccatagagaatgaggtctgcatgacttctgattttaaaaaagagcagacgtaatgagtaataacaattgaagtcgaaattctgtgactaagattcttgtatgtggtcttgtatttctttaactcttactccacaaggcattttcttttagaattaaaacataaatgtacacaatatctacttaatgtgattattaagagtttctaaatagaaaaaaccccagcaatattgcatggaagtacttgccttaaatggatgagttctctgttttctgtaattgaaatgaccagctggggctgggactgtaaaatctaaacaagcattactgtccacctagtgacaatggccccaatctcagcatgagattttgaaggaactaacttgctaactttagagcagtggttcccaaacttcttcctgactccaaactcttaaagctgtaacatctgttaggagggactttctatattcattaaagtttattccagttcgttccagtaaaagtcttgctataccatggcaggggtgggggaaaagatatctggagggaatgaggaaagtgtggtttaaaatatttcttcttcttgcactgagatcactggattaaagaatgagtcctgcaaaaaacaattttatatgtgttaattcctcaggtgttaagcatatattaggagaaagagctaaaacatagaggtattgcctatgaggcaaggatgcaggcagttttggtgatatgatgcagctacaaagagaagatggtgcttgatctattattatcctttttatgtcactgatttttgtttttgttttctacttgaacatttattgagcagttatcttttcattcttgagtctactgaaacaaacatgccgcattttgttttacataaaaggcacataccatatataatgtttaggattttttttctagtcacttaacaatatattttagagctacaacaaaactacttcattcttcctttatggctttatagtttactactgttgtaaatgttccaactatgttgtctatgaatggaaaactgtttttttaagttttctcctactaaaaaaagtattataataaatgtctatgtatctacatctttgctgtccaaagagatgggcatttagaagtttggcagattttacccaattcttgctcaaagaagttttactaaattgtgttcacacccacagtgtatgaaagtgaatctctgcctccttggctgtggtatattgtcatttaaaaaatctccatccatcttatgggtgtaaaaaatggtatttcacattctcatttacattttttaaattatgcatgagactgattatatttataatttttcttaacttttgtttgaagttcaggggtacatgggcaggtttgttatataggtaaatgtgtgtcatgaggatttactgtacagatgatttcatcacttagatattaagcctagtacccattagttatgtcactttattctttgattgctttcctattattaaaaaaaaactaatagatctttgttataaaaaggttgttcaatataaaatactgtgaatctctccattacatggagctactgattacagttcattttatatttgcccagacatctcttttctggaatatgtatctattcgtgtgtttatgcatacatgtttttcttacacatgtactaatatatattaatatgcaattactcatttgtaactttgatttttttaccaaaatatgatcatacatttgtgttttgcttttattcacttagcaattttattaaagatgtctttccttattagtacttacatagacccaccttattcttttaaaatggctgtgttgttttcaataatatagaagtttcataatatatttaactatgcccttatagatgggcattttggttctttccctttttcgttgctgttataaacaaagatttggtgcatatcattctgtgtatatttgtatatctatgtatttggtgtgagaaattctgtaggatagtgaaaaacagaacctatgattcaaaagagtacttatttttaatattgacacatattgccaagttattctaacaaaatggccatagtgatttatattttccttcaacagtgtatgaaaacaccattttcttacatttttatcaacagttggtattactaatcttcaaaaatttttccaatatgatggataaaattatatcttgttttcattattttgattattggtggagttgaatataattctatatatttcaggccatgtacacttcatctaagtgaattgttgctcattttttcactttatttttttttcttttttctttttcttttttttttttttgagacagagtctcgctctgtcacccaggctggagtgcagtggcgtgacctcagctcactgcaaccttcatctcccaggttcaagtgattctcctgcctcagcctcccgagtagctgggattatataggcatacaccaccacactcagctaacttttgtatttttagtagagatggggtttcaccatgttggccagactggtctcaaactcctgacctcaagtgatccacccgcctcagccacccaaagtactgggattacggacatgagccatcgcatccggcccttttcatccatttttctactggggcttttatattttcttagtaatgtattatggctcttaaccctttgactgttatgtcacaggtatttttttcccccagttttcttttggccttctaattttgtttaaggtttattttttttttctgtaagaatctgacattttaatacatttaaatctgtcaatttttccctttatggcttttgaattctatttcatgcttatgaatctcttttctgtctcaagattttaaaagtatgccttattttatcattgaagttttatatttagataatataaatattttgatttttagaaatttagatttctagttacactggaactttttctgattgattcaagtaggaatgtaattagacttcttaaatatgaataacctgttgtttcaacaccaggggacacatcctctattctctgtcacggtgtaggatagttcatcctttcctagtgatttggagtatctatcctacactaaaacgttacatacacatagatatgcttctctactttttattctgttctgtgattaaaatagtactatactgttttagttattttaaggtatattttcttaactgagaaggtaagtcctcattttccccccaaaatgtttctgcctatttttccacacttattcctccagaggcttttcattttaaaatatggtagtgataatctcagaggcagttttcttggtccaacccttgtagttctagttttctagcctttctttcaagcattatcatgtcttgaataataatggggagaaagagatacagccttccttctgtctgctaattaatgccttcccaggacacttttccctgtgcccatcattcaagtagtcttagccctgagatcctgtaaatttttgtcccaagtacttattgctgcatgatagactaccccaaacctttttgttaatgggccagttgggaccattaacaaataaataataaataaatttttatctattacttttcgaaacagggtcttactatattacctagggtgatctcaaactcctgggctcaagtgacttcctccctcagcctcctgtgtagctgggattacaggtatgcattaccactcttggctctatcccaaaccttagtgggttaaagcgataaacattttattgcatgttataactttggggtcaggaatcagggcagagcttagctgggtaattcttttattttacatgatatgaactggggtcagccaatgctaatctgctggtaaccagtccagtctactgggtccatggtggtttcactcatatgcctgggtgcctttggtgggaatggctggtagcctgggttaagctggatcccgcttcctatgcttgtggtctcttcagcgggatagttggacttacatatctgttcaaggctccaagagtaggcattcaaagacataggaagtggaggctgccattctttgaagatctaaatttccaaactggcaccacatatccgcaagatactgttagtcacagcagttacagagcctgcccagattcaaggagtgagggcatagacccccacctcttaatgggaaaagtgtcaaagaatttgcatatggcagtttctaatgattactttgtgcatgcttccatggcatttagaacctaaagtcagaccatgcgatgactttattgttttatgaactccagaaatgtacatatacaatttatatgagtgtgtgtgggtgatgatatggggaaattagaattcagacaacctgatccttgaaaacaattggttatcacacagtgactgttgactgaccgttagtctgacttgtgtttttcaaaatgtccttgtcaagtagagctcagttgtctggagcactgagcctgtgagcccaaagccagcgtgtccatccccacgtcagactagaaaactgctgtcgttctggccctgagtttacctatctgccattgcatgtgtgggtgtgaagtgacaacatgacagatgattattgtagggaaaaacaagcccaagttcttctgcacttgggtctgaggtgtcatcttagtgcataaaaatcataggttcacattgcatgtattttgcatatttggagactctagtagaaaactacgttttaattaatttctttttacaagtagctttgtatgttctcaggcatatggaaatggggaaaacatttttttaacactttttattctcattcacccaaaagtgatataattttccttttatttcaaaatctctgtgttttccagcctgggcaacatagcaaaaccttgtctctacagaggtaaaaaatgaaaaaattagctgagtgtgatcgtgcacaccagcagtcctaactactttggaggctaaggcaggaaggtcacttgagcccaggagtttgaggttacagtaaactatgatcatgtcactgtactccagcctaggtgacagagtgaggccttatctcaaaaaaaaaaaaaaaaaaaaaaaaaagtctgtgattcatcatttactttaggttgctcataatattatttgcttttctcttgactattggcttaaaaaatcatatgtactttcaccaaagaacaggttctcaaacagataacgaattgtgtctttaacctgagaaaattaaaatgctctgttcagtgagtcaaaagttttattctcaatgctacctttcttgctgttatcaatataatagagaatgtattgcatatcagtggtacatgtgatcctcttaaactgtgaaattctattttagtgtagattccctatccttccatatggccttgaagtgttgcaggacaggggggccccaaaattgaggctctgcccaggaagtttctttattttgcccaggaagaaattcaaaggcaagctggtggtgaaagaaaacagctttattgaggcagcagtattacagcttcatgattgctcttgcagagcagggtcaccccataggtagtgcagcaagaatagcagctcaagggcagtcaggcagtcacatttatatctgcttttaattacatgcaaattcagaggcaagttattcagaaatttctagaaaagggttgtaacttctgggttgttgtcagggaatgggtgaactgtcatggctttggtgggcatgtcagccagtcttcagtctggtccagagtcgatccctgcctcctacttcagaaataggaaggcaagaccctttgtgcaacagatgtaaagaatgatttatctcaactgagaatgggaagtcccattcttgtgtccccacatctagcctgctctggctcatagtaaatactcaataaatatttattgagtcaatggccagggcaatgatttgaatgtactgatctatttccagccttttgtttgccctattgaaccccattgtctcagaacatgctgtgataatagactactctcaggttctgagaaaaacgtgaatgttctgttctagcaacattgcaaaaggatgttgtaattgctgtaggcagcgccctttggaggcctctctggcatacagaagcccgaaagcaaaaatcaaagaaatgattgcttcctgtaattatttttgtagccatgttgctgagtgcgacacatgcatctctctctttctctacagaaaggcacctccctgggcctggtgggtattgatcacaatatccctgcccaggatttatgtcaatggatgtgtgaaaatcactgatcccataacaattttgacatttatgtagggataattgctgcctcctttttgatcttagataatctttactatctgaggcatactctgggtgcatccaggtctctgtgcctttaagtccaatggggctggcttcatatactcatgttgatttaatttctcatctttctccccaggatccttttctttcttgatatattggaaataccacttttattctgtattatagttactcattccttctcacattcctacacacctttccctgttggactctcatgcccctttcctccccagccttcaagaaagacaacatcaaagccagtcactcatggaaaaatgcctgttcctttagaaggggggacacaaattcaaatgtagtcagaggccaagcagaaaatgaaaatgagggaaacatgtaggtgtaaaattaaacaataggaagtagaggggcctggggttagactgaagaggttatgccctctgtatcagaatcttatttttaaggccagggaggccaatcaaaatgtgtcttttgggtgaatctggccagttctccctgttgaatctatagagcactggatgatctcaaagggatcctcttgagacctttaaataacgtatgtcactatggcatataatttcccccataaaatgccacaaagtatgtgaaaattttaagtagacccttcagtactaacaaaaatatgatagtacaactaagttggctagggacactcagcctcacaatttgaattggtatctctaccaaatcataaattactgtgtgtaataaaccagtgggttgcttgcaaatagtcaaaactattactgataaatcattcaaatgctaaggaggtactagcttcctttttatcctgccactagatctttatacatgttgtttcccttgaaggaatgttctccccaccgctaccctgaaccttccctaacctcttattaactctaacttatcttttctaccttagctaatattttttgcatcttcagggatatcttccctgattctctcagcctagaaccttctcactttgatttgtggtatttacacttcatgagggtgattatttgatgaagtctgtcttggctgctagactggcatgcgtgtgctcactattttatccccagtccagtgcctgctccatggtgctagttctgcactgaacctttccctattgttgaataaatgaataaatgaattttctgtagacatcttttttttttaatttgaagtttttggattttcttttttgaggtgaaattgacatagtataaaattaaccattttaaagtaaacaatttagtgacgtttagtacattcaccatgttgtgcaaccaacacctctgtttagttccaaaacattttcatcaccccaaaaggaaacagtgtactcattaagcagttgctccccattccctatttctcccagaccctggtaactatcaatctgcattctgtctctatgcctctacctattctggatatcttatataagcggaattatacaatgtatggccgtttgtatttggattttttcacttagcataatgttttcaaggcttatgcacattgtagcatggatcagtacttatatcctgactgagctatgactgaataatattccattgatttataaacacaatttgtgtatccattcatccattgatgaacatttgagctctcgacgaaaagcgtcaaactctgtaaaatatttgaagagatttattctgagccaaacatgagtgatgattgcccgtgacagtgccctcaggaagtcctgagaatctgtgctcaaggtgactggggtgcagcttagttttatacattttagggaggcataagacatcaatcaaatacatttaagaaatacactgggctgtgcgcagtggctcatgcctgtgatcccagcactttgcgagaccgaggcgggcggatcacccgaggtcaggagtttgagaccagcctggccatcgtggcaaaacctcatctctactaaaaatacaaaaaattagctgggcatgttggtgggcacctgtaatcccagctacttgggaggctgaggcaggagaatctcgcttgaacctggagatggaggttggagtgagccaagattgtgctactgcactccagcctgggcgacaagagcaagactccatctcaaaaaaaaaaaaaaaaaaaaaagaaatacattggtttggtccagaaaggcagtacaacttgaaggtgggggatggttccaggctataggtaaatttaaacattttctggttgaatatgtctaaagacctgggattaacagaaaggaatgtctgggttaagataaaggattgtggagacccaagttcttatttatcagacttaaagtctgtgttaatgttaacgccagagatgtataatgatgcatgttagaccccccacttcccatcatggcctgaaacagtctctcaggttaaattttaaaagagccctgactgaggaggaagtccattcagatggttgcggggccttagaattttatttttggtttacggggctgtttccaccttttgtctattgtgaatagtgttactgtgaacatgcatgtgtgtatgcttgtttgaatacctgttttcagttcttttcactatatatctgggagtggaaatgctgggcgattctgtgttttagccttttgaagaaccaccaccaaaccattttctacagtaactgcaccattttacatccctaccagcaatgtatgggagttcagatttctccacatttgctccaacactttttgttttccattttatagccatcctagtgggtgtaaagcgatactcctggtggttttgatttgcatttctctgatgactaatggtgttttaacatgttttcatgtgcttcttggctatttgtatacctactttgaagaatgtctattcatgttttttggccacttaaaaatttaactgtttgtgttgctgagttttaagattttttctaatatattctggatactagatccttatcagatatatgatttacaaatattttttcctgttttgtgggttgtctttttactttcttggtgatgtcctttgaaacataaaagctttaaattgtgatgacatccagtttttttttcttttgttgcttgtgcttttggtgtgtcatacctaagaatccattgccaagtccaaggtcatgaagatttacctctatgcgttcttctaagagttttatggttttatttcttatatttaggttgttgatccattttgagttaattttacatttgttgtaatgtgtgggtccaacttcgtcttttgtgtctgtatatgcagttttcccggcaccgtttgttaaagagactattctttctccattgaatggtcttggcaacattgtcgaaaatcaatcaaatatatgggtttatttctggaccctccattctatcccattgatctgtacgtcgcttcttatgccggtaatcacactactttgattgctgttgctttgtagtaggtgttgaaataagaaagtgtgagtgctcttttcttatttttcaatattgcttttcgcacggggtaactttttatttgctcctgactatgtcttatttctttgcacaacctcttctaccactcacagaaccaagtgtcctaagatgcacgtttcttcaaggtttcatcttttctcacagtcacaaatgtgtctagactacagttcaggtttgttgtgatttcatgatatgactactttaagactggtctgggacagggtaaattgatagaagggagctgaaatgtgacatgagcatccttctctgactcatccagacagcgtttacttaatggtccatttacttatctatgagcactgagtgtgagaatggctcccctaatatttagtacagctcctggcttttagtaggggatgactgtgcctatttagtgtattgctgaacaaagaaatccctgactaaatgtgagtagatgtcatgtcattgcctaggcaagggttctgaccccattgacaaaggacttgctggtggtgttaataaaccagttcttaaattgtgatctaagtttgatctgaaccaagaggcaaatgccatcaaagtgaatcctgcgtggaaggctggtgggaaggaatagaaatgtttattttgcaattagctaaggataagggacacttttctgattattttgcttggtagctctgcagaccactgttctaaccacattcactgagggttagaggccagttgaaatcacttccgtttggtatccagggaaatcacacctacgtacaattttgggggcatgtttccctacaattattgtttgaattctggttacacttaaagctgatgagtttcttggtgccttctatggagtgctgattttcacctacatacctgcaaatgtttctaagttacacatagaggaactatttatatttcatttgtgatataatcatggtgttttattttcttaaccattatggaattgaaggacctagacaactgggtatctgttttagacaaatgtaataaatgcattagcattgccccttcttctactcccagtaattggcattcctgctttctaaatttgtgatttttttgactgtaataagaaataaaatattgcactgtttggcactttgaagttggcctgcctgggttgttcaccttaatacttaacatccttgagatagttatttcacctttctcaacttcgttttccccctctgtaaaataagggttatgacctttcccttgaaggggagtaatatggattatgtgaggcatgtagataacatgtatggccaagtgccaaacatagtgctcagtaagtacatgaaagctccccatatacatactaaaaaaaataaataaataaaggttaggggttggggttaaccttagaaaaatgattccagatgaagagagggaaaaacctacagctgagcccatcttcagggccagccttggtctatgtctaatcttgctgctctctgatccagtgatagcatctctgcacttgaacactcaaaatgttcctgaaagggacctacattattcagatatgcagccagccacctggaccctagaatcagttttaatgtcagcaagcatgatctcttcaaaatgctcctttgagaatatcctgaattcatttagtattgtttccccctcttctgacagggcctctcttcctctttccacgcccacctcttggccaccctctcatcccagcagctgcaggcaagatttctctccagctgtccatcaagtcttcaaaagccagccggaatgtaattgtaatctattttccacccctcaatagtagcgggtgaaacacacacacagacacacacacacagctcaaaattgcaaggagaagggagccagagctacctcatgactcacacacagccctgcatggataattactgccattcattactggcccaggaaagaaaacaagggtccaattgggttttcgtgaaccacaaggctgacaagtaagagggggaaagaaggggactgtgctccctccctacagcccccctgccaatgccattttcagaaaagtaacatcctgctggccttctattcctggcgcacatcttttattatgtttatttagtgtgcagtttagaattgatactgtggccaaattctgccaagcacctctccccagaaggaccttgagccaggtccttctttgcctattttgcctattttcctgtatgagggcaaaataggctccgtttcattaattcatgtatatgttcaaccaacagtttgcatgaattcacagaaaagagctagattctgtaggaaatgtccaagctgcattcatctcaatgaagtgtgtgtgatttgctacccactgtaacccctgcctagtaacatctcttgcagccatactagggtgccatgtgctggctcatcccactgaaagcattctgtccctcctctgaattcccttggttgtgctctcatcttatcacctttcattagatctttaattgttgtggacagaaaacatcactaagaaaggggtagtatatacaaaaatacatctaatcagctttcagcagttttttatattattggtgggaaattcaattaaactgtattgaatgaatgaatgatcaaataaagaactatgtattttaaactaaatgttttgtgatggctatggggagaggcaagtcctaatgaaacaataagatttgggttagttggcagagatggaaagtccttctagaatgggaagtgttggaagaaaagcatcttgtgctggtgctgggagtgaatctctagaattagaatacatagaagactacgctacagctgtattactcaatgttgtatttcttactcagcattactcagttttgtgcccactatgctactcaagactggtccatcagtatccacgtatttcatttggcaacagtcattcttggcaggagctcattaagtgtatggactttgtactgggtgattacggacccaattgacatttttaggactatcaagttttgcttcaaattacaggcatcctgttgttcttaatgttttattctgttggtttatgattctcacaaatcagcacacaattccctatttctttcgcttctgaaaagactgaagctttaggaattagaagcagcatttaacttatgattcctgagagtctgcattattttgcagactgattgactgatttctcagaaatgtgtcataccatgtcagagataatctggagaattagtgacagtgaagagacatacaatttacttataattcttttttttttttttgaggcagtctcgctctgttgcccaggatggagtgcagtggcacgatctcacttgaacctccgcctccaggttcaagtgattctcctgcctcagcctcctgagtagctgggatcacaggcatgcaccaccacacctagctaatttttgtgtttttagtagaggtgggttttcaccaagttggccaggctggtcttgaacttctgacctcaggtgacccgcctgtctcagcctcccaaagtgctgggattacaggtgtgagccatcgtgcccggccttataattcttaataataggggtaattttaactattgcctattgaatgtttacttcatgtttgacagtgttaaatgttttacatgaatcattttatttaacactcatttgatttctgtaatatatgtaccattgctatcgcattttacatatgatacaactgaggcttagaggagttaggaaattgcccaggctgatgaagatagtaagcactagaactggaatatgaacccaggcaatctgacttcagagcccacactctgcaggctctcctagccttagcttatctctgtgactggaaccctgatcctgacagatatctggaaaaaatcacattctttgtctcctaggatctaggcagatcaatgcaaatgtgatctcaaaatgacacatgtctgggctatttcagagatgattccaaagctgatttagtggattattttttactggcatgattactattgattgttattgtgttcttagatgaaataattggcctagtattccatattcccatatctcacagtgttatgatcttcaaaacttcagccatacatgcatatgcatatagacacatataaatgtgtgtgtattaatgaagtatatgtacatatgtgtgtgtattaatgaagtatctgactttaaaagctaattaattattttagatataacaatttactgaattatttccaaattactctgaaaccaaggtatttctaggaaaatcagctgaagttcttaaaatggtctttaaatgaatcatttcctcttccaaagaatttgtttttgttcctaagagcaattttccctcactgcatcttctgaatactcataaaatcttcattttaaaatctgaaaaggtcatcttatctacccacttatgcctgggcaggaaatcttagaagatcatattactgtttttaatgacctatggaggatgccatgccacctattttggcagtttattgcctttcctaataatctagctagtcagcaggtacttcctgatgtgtgaacaaaatgtcttctgctgccttggcttattccatttgatggtcatgagactaatgttatcttattcatggtccttttcctaaggccagaaaatcacagtatctataactcagtcgatagttatggtcacattctaattccttaagtgcctccatcttgaacagtcctctgagtcccaattgttgtaatgtgggtgaggtgctgtgagcatgccatctgtttgcgagaatggtgccactgatggctacacatttgacactgaagatggcactgctcatctaaatcaaaatttgggacctatagaagctggctgcagacacctgcattgactctcactttgtaaagagatgtggccattggatggaaacatgagcctggagtgtcatttgtattgcatttttgtttattgaggataactgctatactcatctttgtataaagcatggaagtaataggatcaaattaagaaaaactacttagatggaatagcagggaagtttccctaatgaaaagatctgatagaccatggaatagccttccccaggaaggctggtctcattgagatgtggttattaccgagaaaccaaatagtcccccactggatgcatcttgggcgatttgcattttggtttgtgactttgatttaattggaaaagtatctcacatctgttgttgactacataagtctgtttcccaaattctagttatgtcacagttgcctagcgaacttgttaaaatgcagattcctgggccctgttcccagaggttctgtttcattaggtctgtgatagtctgggactctttgtgttcaccaaatttcctggatgattctatgcaaagggctgtaaactctgttttgaaaaacatggagttagggccattttgggaagatttcagatctgatagtaagtgtatctgtgtattttgatttgtcccttatcctcatcctaatactctagtttgccccatcaccagagtcctcttctgtttgcagataggaggaaatgtttggtgaaagaccggaggttgctaagaggagagtatttctccaaggagccctaaccttactcaagctggcattccctgtgcttcccatgaggcagcttactatagggtagtgtttttcaaaattctgtgggaatttattcttaaaaaggaggttccatgatcagagaagtgtgagaaacattgtggaaaacaaaggtaaccagatgctttactgcaggatttcctagagtttttatcgtgataaaatcttcaccattttctaaatttttggtcacaggatttctcatgggactactgattcatgggacgcattgaaaaactcagtgagttgaaagcaagaaaaattagtttataactgctacttttcacccaaataatagagtgaccttggatatgtcctttattttcctcaagtttgttttctcgtctgtgaaataagagtaatcatgccaccttacctaggtcatagggtcattttgaggattgaatgaaatacatttgtgacagtgctttgtaaaatataaagcatcattagttgtcattgggaaactaactagttgcatacaagtttggagagtagagagagagcactggacagtttatattcatctttgcttagactttccttagattgaccaaatgggactgaaaaatctggtctgtttacttcaccagggtttgtcttaataccatgttaatggttaactagagattctcttttactactttctaaattattccactgacacactgatttaactaaatattatagtccttaataccttgtagtcaatgcagatccaggactaggaattggtggcacatggtgaaggagatgttcagggctatgagccaataggatggggagggctaggactgggaagaactggaagctaggatgctgatgtggttattgggctgtaccccatgatgtgagtggtctcaagcgaaatttccttgtcttgaagattttggccaaacttggggtcaaataagtaagagtcatatataagagatccagtatagtgggtggcaagagcagagcaggaggtacctctatgcagagaagacgtatataaattcagtagctgtggtgctgtaattctgagttgttagtgtgggttggagcttgatgacaactaacacccaaaggtatgagaatcaaggtccagaccttctggagatgaggccaaaaaaatctgtgtcatgtgtcgaaatctcaccaagtgagcttagtattagccctagtggtgtgaccatagtgtaatttagcaaaacaatagggaaacccaaatatacctatggaacaagcatagtggaacttgagaagaaagaataggaaaggctgaagaggtcacatatgtggggctaatctttcttaccccagatctcaggtttagggtacaaaactaatttcagatcatgtctgctaggatgaccaaactcctacatcagcagtaataatagcaaaaggttattgggatgcttattttatgacaggctttactctaaacactttatgtagtagctcaattctcaaactgcactatgagttaggcacttgtagtatttgcattttctaggttataaatttgatgtagagagaagccaagtaaattgttttagttcactcagctaataaatggtggtgtgcagacttgaattcataaagcttgtctccagagctatgttctttttcaccattttaggctgcctccatcccaccccaatgatggtgaaaagtataattgttgaaatgaaaaaaattaattatggatctcatcagatttgagatggtaaaagaaagaattagtgaatctgaagagagatctatagaaattaaccaacctgaagaacacagagggaaaaaaagacattgaagaaaaattaacagagctacaaagacccatgagacaccataatgcattacaacatacatgtaaaggaacttccagaaggaggtgagataaatgttcaaaattttgtttaaaaaaataagaggtccaaacattccaaatttgatgaaaacattagtctacacaactgaaaatctcaacaaacccaaagtagcataaatacaaagagattgagacctttacacatcctagttaaactggtgaaagatgaagagaaaatcttgaaatcagcaagggaaaaatcaattgatcatgtgcaagggaaggtcagtatgattaatggctaacttttcatctgaaaagtagaagtcagaaggcagtgggatgacatattcaaagtgctgaaaaagttgtcaaccaggaattttttatgtagcaaaattatccttcaaaaaaaatgaagttaaaataaaggaaaccccagataaacagaggttgagagaacttgttgctagccaacccgccttacaagaaatactaaaggttgtccttcaggttgaatagaaatggtaactgaagtccacagtaagaaataaagagcacaggaaacggcatagatgtgggttaatatgaaagattctttaaatatatttttctcattttctcagccctcccccgccccaagtagctgggactacaagcatgcgccacaatgcccggataatttatttttagtttattttttgtggagacaagttctcactgtgttgcccaagctgatcttgaactcttgggctcaagcgatcttcccaccccagttcttccaaaatgttgggattacaggtgtgaaacactgtgtctggccagatgctattttataatgaaaatataagaagtatatttatttgtggcatcacgttcataaagcagaagctatgaaaaatacaaggagatgtacattggttgcaaaagttatttaatgaacctatctcattttgtgagaaatagatttaaaaattaagatagatataaaaataagcaacagtgtatgtttttgtgaatgtttcatgggcacttgaaaagagatgcatcctctaatttcaaggacagggcttgagatatcgattggtatacacttagttttaaatataattatatatttatgatatatgttatgtatgtcatatgtaaatattatttacatatatatatgtgcttatacctgctatgaagtctacagagacattctcaaatttcaaaaatgtaagtagtacagacaacattctctgaccacaatgcattacaactggaaataaacaaacaaacatagaaaacaaaaagtccttaccacctaggtatgaaaaaacaaaaccatctttaacaggtcaggtgaaaaaaatcaaaatggaaattgaagaatacatagaaaataacaattttcaaagtactgtataaccaagctgggtgcagtgtcatgcacctgtagtcccaactacttgggatgctgaggcggtaagatcacttgggtccagcatttcaaggctgtagtgccctatgatcatgcctttgaatagccactctagtccagcccgggcaacataatgataccccatctgctaaaaaaatcgagaaacaaacaagaaaactccatgtcagaattaatggaaaatagttaaagcagggattagaggcaaattcatagccctgaatacctatattaatgatccagaaagaatgaaagcaaatgaattaagctttccacccaagaaattacaattttaaaaaatctaaataaaacataagaaaggatttaataaaatagaagtagaaattactgaagcagaatgtagaaacatagtagaaccaatatataaatcatgagctttttcgggacaaaaataataaaatagatcgtttattaactaacctaatcaagaaaaaagagagaaagtttaaatatacaaaaaataaaaagagggaagtaactacagatacagaggaagttaaaagaactacttatcttagttccttgcgaatgaacttgaacaccttaatgaaagggtcctttttctaggaaaatataatttagtgaaaagaaggagaccagacagacaagaatgcagcattattcactagtcattcacaactagagtgaagtgagagagattacagtttcttctcaggcatgtctgggacatgcctgaatactcagtgtgtttctgatgacttaatgttgatgtatttatttttcatcttaattaagatgcagtatcagtgatacacttccccagtttctgaaaattcttgtgtaaatacacttgctggcactgtgtgttcctgctagaagagtaggccgggtgcagtggctcatacctgtaatcccagcactctgggaggccgaggcgggtggattttgaggtcaggagattgagaccatcctggccaacacggtgaaaccccgtatctactaaaaataccaaaattagctgggcgtggtggcacgtgcctgtaatcccaggtactcaggaggctgaggcaggagaattgcttgaacccgggaggtggaggttgcagtgagccaagatcacgccactgtgctccagcctggtgaaagagcgagactccgtctcgaaaaaaaaaaaaaaaaaaagagtagcagcactataatatagcacagttcctccaccttcaccccactcccaccccaggaagtgacaacagattgatttttgaaaaagaaatctacgaaataaacacttatctattagtctccagtatcctccttcctatttctgtcccctcaaaaggttgctaggcaaccgggtaggaaaaaatgtccaaagcccttttaaagagaagacatgcttacaatgtcagaaaaataaatgtgtgcttgctcagttaggcccccttacaaactgccaggacccgcagcataatccattcagtagcaattattgcaattgatcttgaggttggtgaaaacaattggccatattctggctcagtggagacatgacccaagccatccaggtgtgagagggggtgctgctgtggtgtcttttgcccttgaaagaggacgaatgttcggtagttactgctggggcctctctgcccatgtgtgtgattctattcttgcagttagtacgatctctataaagcctttgtagcgctcactgttgttgataaccagtcttcctcaggaactgctactacatctcctctggcatttcatatatccacctgactttaaatggagcctgtcagcctatgcttctgtgggcattggcatgcacatggtctctggtgatccaggctcagattgctctaaggaactgtacagccttcctacctggtgtgtgtgccagggtctgctcatggtgacaggtgttgatgttcagctgctaatttcccccattagagacaatgtggtaggatctgatggtacaatctgttcatctgaggtctgccctgattttttctgtctagaatataatgctaactttatggaaacaataaaagaagaaatagatgcacaatctgccctttaaatggttttgctttgttgaggaaaaaaaaatccatagtagtcaatttctttttgtctattacaaatttattaacagtgtgtcataattaggtgcatggctttgccttagaggacaaatggtgcttgttgaactgtgacgttggtcttattgtggtaaaatgacccatttggttttaccagctgtgactttggagggagctaaatgacagaaaacacgtaaaactcaacagatgaaaacattctcagctcatactctatcgctgatcattcagcatctcaaacaaaatgttctttggatttgcttgctagtgtcttataatctgaagaatgctaatgcttaagttgataggatgaactgaagaataatatgcttgagttgatgcttaagttgataggatgtcagaagggcaactggcttatcatatcaggcctggattccccattaatatgatataaaatgctctagcagaatctaaagaagtggtgtctcattaatcaagaataaatcccaaatgcagaaacaagatggttgtaattgtggactttggaattgggctgcctgcatttgaagctcggccgcaccattaccagcttctgaacttctctaagcctctgttttcttatctctaaaacagacttgtttatcttcctcatagggtttatgtgaggattaaatcagcacattattagcacagtgctttcacatagtaagtactcaagaagtgagttattattatctaataacttattattgttagctgttgttattattatcatgaatgactcaggcttcagaaatattagactgcagaaaaatggtccagcttataggaaagtcttgggttcctgactggacctaaaagagccagggggagacccatgaatcagctccctttggctgactccctatctttgacttagcactcatgactgagttggtgagaaattggggcccagaagaaaaaggagttccccttttatggccatgatcctggcaaaagagcttcgaatcacgtggactttcactggttcctttacctttctatgttgggcgaaatcctagaggcagagcgacaggaaagagtcagaaaggtgccatgccacctgactcttcactttttcagctcatacaacattggaatcataggaacggaaacccataaagagattaagtctgtatttgtggccctttcccctcactggcccctttgctggatccctttttctacatttttattcttgactgtcatttatcccaaggaagttttggtcaataaaggtttacaaaaggatgcctcacagaacattcccatttcaaataaggaacttctggattgaaaaactatgagtcttaatgaggaaatttcatgcccatcacaagacatgtctttttaagtaggggaagagggtttctataatctcttctttatctctcaaatatatgcaagtgctcctaatgtcggaggagactggactcagtcagttgacgatagcttgaagttgcctattgcaagccccaaattgaaattccttagaagctggttttttgtctttttttaaagagcgttgtaacattcctggcctctctctgttttctaattcacttcgttcctgcacttttcagcgctgaatctaccctttgctctgctttgtgatgctggagtggacttggtgaacatttcttctttgccatgtggcagatattaagctttgtcagcagagggcactagaaggccactgcaggaggaaagaacgctcttgcaggtttcagtgtgctttttcctaattgcttctgtggcctttggctctcagtggcatttgggacaccctgtggtgctcaccctccagcgaattcttctggcacctaatctggtggcttctcaatgaatttcaaaggcaccccagcaggtggtcttatgcttgccagccctggcttgtctcacctcagagaacttcaccacggaggcccatagtgatagcctttccactgaggcctgaatctcaggcttgggtttgggggcaggggctcttccaaatttgtttcttcttgggtactccatctcagtagaggtagcagctgcttccaatacctgctatatctgtattctttagaactctctttactccttagtatctaatccgctgttacaagttaaacattcttttttgttctgtttggtttggtttttttttgagatggagtctcgctttgttgcccaggctggagtgcactggtacaatcttggctcactgcaacctccgcctcccaggttcaagcaattctcctgcttcagcctcccaagtagctgggattacaggcacccaccaccatgtccggctaatttttgtatttttagtagagacggggtttcaccatgttgaccaggctggtcttgaactcctgacctcaggtgatccacccgcctcagcctcccaaagtgctgggattacaggcgtgagccactacgcctggcctaagttaaacattctttatattaaattttctttgttcaaatttctggtgtggtttccgtcttttgattggacccaaactgatagatgctagaggatgagaagtgatgtatgcagatggtgagtttggggaggaactggtcgtgcatggtcctgctctttcccttctgctttcttctggaagttagcctgcctgcttgattgctctcagcgtagttaagctcaggggcaaaggctgtgttcctgactgaggtacctgtggtggtccagcccagtcccaagactggccagataagtctatctctacctctgcctttcagtttgagaaagtccactccctgcagatgaaagctacattctccaagatcagttctatctataataaaggtattattttggaccttatctgctgactgtgttcatcgtgttcagaatccaggtagggagaagtcctgtttttattgccactcccctttccccaacaattttcatataaaacaactcttttaaaataacttgccaccagaaaaagtgattgataagcacggcatgtttaacctttggctttaactataccccggccctcccccataccactgtggtttttatcccaccacacatataaagcttttttttttttttcttaaaatactaatctaattgaggagtgattctacatctctcattagacacactgtaatgatcaccttcaaagagcacacttccaaagaacccatgtaaacagtccagaatttgatgatggaaaagcatttagagaacaacatgatctatttgaaacacatctctttaaaataataatttttttaaaaaaattatgcatttacaaatgtgtgtgaaaaagaacagggttgtggtttccactctatatgtgaaggaccacctaggaaaagggtcgttagccagtcctggggcaaggtctacttccctgacacactggacaataacagttggaactgatgatattgccgagttcttattgaaggaggaaattaaagaatggatgtcagtaaatgaccacattggctcagacaacgagccacacacccacttgtcccctccatcatctctattgacatggcaccttctattgtccttgactttctcctgcactcttcatgcatggctgaattgcttatgcgtcctgtgtttgcgtaaggagagtacagtagagggaaaggtaccccaatgtgctttagagataatgagaaaatgtgattcatgccttttgtgaacacttacattttgaggtagtggtcaaggattaatagagcttggtgacacccccaaacctctgcaagtcattcccacaggcctggggtaataatacctgatatgggaaacatgtaatcttcatattctgggatggcctttgaagcagattggtgctgggctggaaagccagaggacgtgaacacctgtcacttactgactatagtggttaggaatggtttattatgaactgggtgattcaatgtagtaactttacattttagtgattatagcctaacattgcaaatggcattatttaaggtataggaccaaacaggtcattaagaatcagaatcaaaagaatcaacaaggctgggtgtggtggctcacgcctgtaatcccagcactttgggaggccaaggcgggcagatcacaaggtcaggagatcgagaccatcctggcccacatggtaaaaccctgtctctactaaaaatacaaaaattagctgggtgtgatggcacatgcctgtattcccaactactcgggaggctgaggcaggagaatcgcttgaacccaggagatggagattgaagtgagctgagatcacgccactgcactccagcctgggtgacagagcaagactccttctcaacaacaacaaagaagaatcaacaagcttgaaatttaactacaagcttttgcttttctccttactacctttggtaattccttcagttactgtaaagtatcatagttattaatcatagaagcttccctttcttagacagtggtaatctaaggctgagatgtgatctaggagcattttgtctttgctttcttccagacatttccccatctaatgttctccttacacatctcttcttctcttccttttccctactttaagggattgaccctgattgggaggtgcctttgtggtggatttagcacttagcatggatatcttttctaacctggacgaatctttcacatttaatgacggtatagtatgtagcattgtgatactgatttctgtttcattttcatatcatctattttctaattataaatgcctccaactatttctgtaattttttcaaatgttttctctagtggaattattagcatatatatatatatacactatatatagtatatatatataatgtataaatatatatatttgaaagacagtctcactttgtcacccaggctggagtacagtggctccatctcggctcactgcagccccgacctcccaggttcagacgatcctcctgcctcagcctcccaagtagctgatactacaggcacctgccaccatgcctggctaagtgttgtatttttagtagagacagggttttgttgtattgcccaggctgatcttgaactcttgagctgaagtgatctgcccgcctcagcctctcaaagtgctaggattacaggcatgaaccaccacactggccacatatgcatattttgaatatatcttcgtctgtgtcacgtatgctgaggttattacccagggatacccaccactggaacgaggtagcagattcttgcaagtggaacccagcaataaggttcagtgtttgtagctgctggaatcgaaccactcaaggtcactatttacagtgtgttctatggagttttggcccacagagcattattcataatcctgtgggaccatttgctgattgcttcctccttggctgtagctctgttgcccccactgctctgaaattgctcactgagccacccccagaagatgcggcagtatattctctctttgcattcaagtttcttggaaggatactaagtgttcatttgtcagtgcttttgccacctaagagatattttaaaagtttgaaatcccatatgacatgtggcatatgtaagccatttcagccttctttctaatagtaacaaaaacagaaacaacctaaatgttcaccaatacatgaacggctaaataacctatagttacccactctgtggaatgccatttaggtatgaaagtgatatggatgaactttaagctgtattactgaatggaaaaaaataagtaccaggacatttttgtggtgtataatcccatttctattgggattatactctcaactatattataaaaattataaaaattaaggccgggtgcggtggctcatgcctgtaatcccagcactttgggaggccaaggcagatcacctgaggttaggatttcaagaccagcctggcccacatggtgaaacactgtctctacaaaatttagccgggcatgatggcaggtgtctgtaatcccagctacttgggaagctgagacaggagaatcacttgaacctgagaggcagaggttgcagtgagccaagatcgctccattgcactccatcctgggcgactgagtgagactctgtctccaaaaaaaaaaatactactactactaataatatattgtccaatttatattgtgacatttacttacaacacagaaaaacagtgtgtgtgtgtgtgtgtgtgtgtgtgtgtatatatataaaatatttatagcagatgctacaaattcatgtaataaaaggtctaaaagaatataacccatactgataatggggaggagactgtataatgaggaggaattttgctttttattctctacattccactattggggattttttttttctctgtcgccaggctggagtggagtgatgccatcttggctcactgcaatctccacctcacaggttccagtgattcttctgcctcagcttcccgagtagctgggattacaggtgcaggccaccacacctggctgatttttgtattttttttttttttttttagtatggatggggtttcaccatgttggccaggctggtctcgaactcctgacctcaagtgatctgcctgccttggcctcccaaagtgctgggattacaggggtgagccaccatgcccagccagggaatgtttcttacacttagatgaatcatgtattacaattaaatgtaaacttttaaaaataattaattttgaacaggtaagatgtgacttagggagaaaagcaaatttaggaacagctggggcaagacagagagacacagacacagacacacgactaactattcaactttattaatgggatttaccaattgtaatcagaatggcagctctgttgctgtagttaatactatcagaacagttaattacactcaaatgtcttgctttcttgcttttatgagtaaggaaatagaatgtttttttaacacattcctaagtgtttaactggatgttaacaattgtttcttagttattatacttcattctttctatcttcctctgttattccccttctcccctaacaccctcctcccctagttagctgatttatgtcccatctgtgaacagaggtcctgctttaaaattcacaactttcaggaagcccttcttaattaactgtgcctcactgagaaattttttactcagcatctccttggtgagtgtgctttaatgtttgagggcttcattttgcaccttcttgaggcattgcttgctaactggttttctgtcattttttttgcatgtatgttctcttaattcatcttccaaagtaatggactcttcacgagataaaatacagaagagtgaggtatatgggcattggagacagaaatacctgaatttaaaacctggttcttccaatttttgctgaaagttttttagaaaatttcttcttttaagttgcattttcttcacttgtgaaactggaataattcctatttaataggattattgcaatgtttggttgacctacatgtgaagcacttggcatgaagctttgtgatagtaagcactcaacatatgatggttattggtattcatctccttctgtctctgacccaccatgtatgtgtgtataatggttgtgacatcagctaatgtctacaatgaggtttaaatcatgatttatttgctcattttggttatatatattcagggacctggcgacatttgggcttcaaaagtagaggaatgaggcttatattttcaaatccaaatcaagtcaatactcctttattcttcaaacctgcttgctctgaataatttagttggaatttgctgatttccgaaagagctgttccatatttgtctaattttatgctactttgaagaccaagtcatattttgtcatatcaccatttcttggcctacctgcaacatgtatatgtttgtgtgaattcattcaaaaaatttaccgagtatttctgtgctgggcactatagatacacatgaaacatgagtaggagcctgccaggtggacaaattagggagagtattctaaactggaggtacatcatgtgcaaaggccctgaggcatgaaagaataggacctgttttggagctacaagtactgtgcagcacagtgctacagcatctggtgagcaggtgatttaagatgaaatcaagtagacaggtaggtggcaggcaagaccatttgtatatatcatgcaaaggagttaacattttatcattctggcagtgtgcatctgctgaagaattttgaggaagaaaaccatgaggtcatatttttatgttataaagaaattccagctaccaagtacaagagggattagaggggtataaggtagagggaaggagaaaaacaagaaggacattggagtagtatgggtatgagatgatgagtaactggactaggatgtgaaagaggggacaggttatgagtaggggatttaggaagtagaactgagaagacttgatacttgattggtgtattagttttctattaccgtcataacaaatcaccacaaacttagaggctgaaaacaacacaaatttgttatcttatggttctttaagttagagtctgccatgggtctcagtgggctaaaatcaaggtgtcagtagggctgtactcctttcttaaggctgaggggaaatttattttctgggtcattcaggttattagcagaattcatttccttgcatctgtagaattgaggatctcatttctttgctagatatcggctgaggcccgtttccatcttccagatgctgcctgcattccttggctcatggccacttcctccattttcaaaggcagcaatgacgggttaagtccctttcatacgttgaatctctcctgcctcttcttttttctttctgcctccctcttccactttaaaagactcatgtgattaagttgggtccatccaggtaatccaagacaacctccccgtctctaggacctttaccttaattacataaataaagtccctttgccatatgaagtagcatattaataggttctgaggattagaatgtggacatctttgagggagccattattctgcctgctttaattggatatggggttaagggagaatgtagaatccaggtttctgacttcaacaaccgggtgggatgcagccttaagaaaggaagatgtttggttttgaacatgttgaccttaagatgtctctgggaaatcaaaatgcaaccatctagtaagtagtcagatgcaccagctaaaaggcagacaagaaatcaaggcatgttaggaagctgtcaacatacagtaagccctcagtgaatgcatggaatgggaagagaatagggagaaaaacaggattctgggatcaataatgttttagctgcaacagagagaggagcactcacaaatgaaacaaaagaataacctacatggtttcccttcactggtgttctttctgggttgtgagagaattagaatttatattgccagtccaaacaaagtattgcgaagtcttcaaattcattgggttttcattatatcagataataatctttcacaagatcttgctttactgaaccaaagtaggatgaactccaggaaaggcaggacatttacaggatcaaatgaggttctcttaaccaacttgctatgatgctgggcttcaaagaagatgtttccttgtgtggtgtttatgtgaagccatagagggttggtggtgacctgggtgagtggtggtttgctgccattctcctcaggccaacaactaaacaatacccctttgcatatttcctgctgagaaagagactgaaaacaggagggtacattgttctctatactaaagtggatattcaccatccatttcatattggacccttgccaggtcactctctacttatagaagagagatgccctttccctgctgggctggccagtgttgagcctactagtgtcatttcagtcaaatctactcagtctctctacaaatgacttagtcatggtgaactgctttgggggtgaatgaagtctattagacagtagattgcttaagcagctcttctctgtgggactgaccttagaacagaatgatcaggaaacctgagaagatcaaggaaagtgcaaatcctggatacggctgtagagatgatctaggataacggactcactgaaagatatagcaccaaagctgcccacagaggtgagctggcagggcatgtaaaacctcagatagccacaggcagtaagaactgctcagtcaaactaggactgaagctgaacttatgtgatggtggtactagggaaagatgaaggcatatgttgttgaatggagtgaatgagataaagaggcagcctcctcctttgtctctgatccagcagaagggggaaaaaaatttaactgctattctttctgggtaatacacagataatttataggtttttgaattataagatatgaagggtaactaaattcgtatgcagaacagataaatcatctccttcctctaatcattcttccttctcatcttatccttcccccctgctctctcttcagatccaaaagatcatatatagtctagcctcaacaaattaggttttttggacatactatgcttttttacatccttgtgtcttggtacgtattgttttctgagcctaaaatggcttcactctccttctctatcttgaaaaatccaatctaattttcagaagccagctcaagtttatcttctataaagtcttttgagactccctagattgagtaagcagcatcttaattattctacccacatatggtgcttgtgcttctagtatatcacttaccatattatgttctaatcatatggtaggaaaatactcggaaaggttatctgactgaggattagactcagctgcatgtaccagtggcttgaagaagatggaagtttatttctctctcttagtaaggaagattagggggaagcagactagagctggtctggcagctttgcaatgtcataatgaatccagttttctatctgtttgctttgtcgtattcagctcatagttttcactttcaagttcatctgatgtccacaatggctgctcaagctctagccatcatacccatgctctaaaaagaaagaagggggaaggagaagaatggcatgtctcccctcttttaaggagactttctggaaataccatataatacttctatttatatatcattgactagaacttgatcacagaaccacatctagccgtaaggaactcaagaaattgtaatctttattacggcagcagtatgctgaaataaaaattgtactataagaaatgagaagataatggatatcgaggggcaaattgcgatcacattatctgatgtatatttatttctggtaattcttgctgcttcccattcctctgcctattgaatctgagcaatccatggctttaggaagcagttagaatcaaggtaaaatcaaggatcacatatgatggctttaaaatttacagccataattcatgtgtgcagaactgtcactttcttcattttctgaacttgagttgccgacaagcccttatttccatgtattgctagaaaaaagtctcatcaattaaaggtaatatagtcacttctgttttgaaatcagatctcttcgtggtattcaagcaaatcagggctcttaccccatccccacccctctttttttttgccctctcaccaagaggttgtctgcttacctaaagttctttctgccattctctcattctctcggacatccaattattaggtatggtatatgtctgtctccttctctacccaggaacttcacggagtctgggacattgttttgactgtctgactttctccagtgcttattgcagaagttgatacataggagatagttaaaaatgtgactatgaatttatgagtacactttaaatgcatcacataattaatccaaatggtaccataatgatctgaaaatcctgtacaattaaacgtctatttcactaaagcccctagcactatgtttagagctttcttatagcactaataatcctcagctctgttatagtagtttgtgtgcttgcctcacccctcattagggtgtctgcttcttgaagaatgttcctgatctttgtaactttcacaggtcctgagaaggccagggacatagtaggtcttcagtcaatgaaaatgaatgactacaggaataagggttggcactttataatctaccactaaaaaatgactctcatatgagaacaaacagattttattagagctatttagaatgatatcaataaaaacaagttgatattttgcctttaatgaaattcttctttcttaagaaaaaattgctgttattttttcagaaatcctccacctactttacttcatccagaaaaatggtgtgaagaattcaaccactttatttcacagtgagtatttcttccactaaaaattgcccatctagcaaggccttgagcagtgattggagaaatccaggctgtggaatttacttgacactagaggttgttatgcctgttagcacgttatgactcggggtttgttctagtaaatgatagaagatgcctttgcaagatgtgaaaagtaaggcgttccatttgactctcagttataataagtccttcttatcatatgggtcacatttatctgagaacctactttgtcttagggcaaatattgacaacttgtcatgtttaatggggagagatgaaacatctaaaaatctgatgcctacattaggaccaaagagaagacagaaggtagcagcctccaacagagtttttgcagtgtgaaagttgggcttcctctaggatctgtggcatgggaacaagggtccagtttccaagatgatagagggacaaagtagaatctcaggcttggggtaccaaggtaaggtatcccagccaaggctcaaggtatgaggaacaaaatgaaggccaagatgatggtgtgacatacctggtaggagctatgtcactaggcaagtattgctgggactcagacaggagcagaatcaacagtgaaaccaatagtggctcagtgctggggtcatgggcttttggaccacactggtcctaagtctgagaaagatactcagactactggaggaggttacagggccccaagctaggggcctggtgaattgaggggacaggaatctagaccaggcattaccaaccataccaaggcagaggagcttggaagaagtcctgtaggatctagtatatgaaacaaggtgttcagaggtcgtgggaggagaaaagaagtgaccaaattagctgataaataagaagtggggaagggtcaacacaaatttttctaatttatgcctctgtgcaaacttagctttcacaaagaagccaggcaataaagcaaagtgggtcttttgatcatcttccttaataaatcacaatacagatcaacaatctcttatccgtatttccaaaatccaaagagctccgaaagataaaagttcttttgtagttgagtcatttagcagcaaaacctaaccttatgtgaactgatttgatggtaacatatgaccttaactgtgaggctatttatagttgttattcatcttacttgatgtgaatattcatgtgtttggcagcagatatatttgtttgattatagtgtgctgccccatatcctgctggggctgttacataatatacagtaaatgtaccagtttacctttgtaaaatttgataaaattctgaattccaaaatacatttggccccagggggtttgtgtaaacagctatgaacctatatttcagtttcattttcatttcaaatgtagtatagttcagggtccctgaatttgtttgcttttcctatccctcctggacttttgccatgttcctcaggaaaggggagtggaaaagaactcaaagacccctgctaagaaagactgtgttggaacatgaccatgaagttgaaggtcaggggtggagggtatctcgttgcccctttagccccacgttgacatttttgtcctggctgcagaatgcactaggagcagccaccagtcaaaggtgatggtgtcaggccatgttgagaggaaaaacagatacttgtaggagggatgatgctcacataagagcagtggaagagccacttccagaggtttgggacccaaaagagtaggtggagggaactaaagggctgaagacatgctggtagcttgggaccacatttcagaccaccccaaggaaacaaatctgggagctaaggttccaatgattttgctggtaaaggctgaatccaaagatttttccttttcatttcattgccacacacagatacccttgattgaccttgtctaagctgttgtcctagaaaaatccattacatattcactaatatgccttcccataccaaactctcctgatgcctctaaaaatgtgatttgactcacaaaactttggcttctgtatactttttcaagagtatgttcgtaatcataaactaagctcggtgttccttggatggatttgagaataaaggtatataattgatgacagagattggactgtacacaacgcagttgactcttaaacaatgcagcggttggggtgctgactaccccccaccttatgaagtcaaaaattgcctataacttttgactctccaaaaccttaactactgatagcttactgttgactggaagccttgctgataacataaactgttgattaatacatattttatgtgttatatgtattatatactgtattcttacaataaagtaagctagagaaaagaaaatgttattaggaaagtcataaggaagagaaacgtgcttactgttcattacttggaagtggatcataataaaggtcttcatcctcatctttttcacgttgaataggctgagggggaggaagaagaggaggggttggttccgctgtctcagggttagcagaggtggaagaaaatccatgtataagtgcatccatgcagttaaaatccatgttgttcaagggtcaactatgcagaaattcctccctaagatagttccttatggcaaatcctattatatgccaattcaaatctgctatgtttttcccaattctgagaatttcagatgcactcattctgagttgcaaaaggtcttgaatactagaatggagggctaaacacagaaaacaatgcctttgagtatgcatactgtcaggagcaaagcaaaaagcatcctgttgtaattgcaagggagggagagtctggaaagtttataatgagtcaggaaggcaattagaaattaagtgattatgtggtttagtactagtttaagatggaaatatgtcatcagtcttcttttttgtttaatgagttgtctttacggttttttattagtgaaaaattttatataataggtgtttatagattccttcttgacctcagccctccaatcctgttttcccataacatcttaggtgcttcaaccataaattcttctgcaatatttttgggaatatttctcaaaattgggaactgattattatattatatatctttaaatagaagcctgcccaccattcccaaataatatactttcttttttttgtttgtttgttttgagacagagtctcactgtgttgcccaggctggagtacagtggcatgatcttggctcactgcaaccttggcctcccgggatcaaatgattcttgtgcctcagcctcccaagtagctggaattacaggtgtgtgccaccaggaccagctagtttttacatttttagcagagatggggtttcaccatgttggccaggttagtctcgaactcctgacctcaagtgatctgcccacctcagcctcccaaagtgctgggatttacaggtgtgagccactgagcccagccccaaataatatcctttcattctgtagaggagactgctgatactaggctgccattactcagcctatcaaatgcagtttgaccaaatgctgtgcattatatttattcaaatctctaattcagtataaacaatgatattcactgggtttgaaatgtctatttaaagagagagccttagtttgtttttatacttatcttgctcatattaggagtcaagggaaagaaagatggaggattaagaccttcagattataagcttttcattattggagggactgggctggagaagatgattatctggtaattttaggaaaagtttcttttaacctgaattatacagataattgcttcagttccctttgtaaaccaagacatagtaaatctaactgtttctctttaaagaataaataggacaaaaagttccttaacggctttaagacctttaatactttgtcctcatgtgactactgagccgtaacagagtcgattcaatactctaggtcttttttagtccatgctggtcactacccaccaaaagatttcgtattgactgctgcagggatctgaacaagttggtctggctgcagcctagtgattatagctatgtagacagggcacagtggggtgtgtgtgtgcacgtgcatacgcgtgtaggagggccaggaaggcaggaaatcaggagcactggggatgtggcttagtgtgtttcagatttatttccagcctccttaatttagagatagtaagagagattttttaaaacatctaaaagtctgaaatactattagtaaacctgtttgggggttttaaaagaagcatcagcctgtttggttctgaagctttggttgttagtgataattgattcatttatattcattagttatgcgtttgtcaaagcatgattcctgacagcttagttatgataaattaaatgcaatgctcacataaattctgcactgcttttcatccatatgctaggaccctgcttgatgtgttttgtcacctctataatgtgtggttggctttgtagagatttcattatcagccctttcccctacgactaaagctatttgcataacaagtttatctggttcaagtaccagccagacttctgctttgtcaggaggctccattcagaagtagccttttgataagataaaaataattttcattttgtcaacttcaccttggtcctaatggatgtcacttttctttttaagttcaagctaatttcaggtctttggaatcaactacaaaaatacttaccaagtcattggtcacaaggtatttgtgagctatgctttctcattttgcctctataactttagtggttttttaggaattaaatttaggacctcatcatcagtggtccttgagccgattattgagacaatcaagatggatttctcttggtcaagggcaattccaccaatagcatcacggctgctcagctttggatttaatgatgacttgaactacatggtcacctgcacatgaactgttctttcttgaggtggctggcttgggtagtataggggagaaaaagtaatatcttttcatcacctactgtgaggttaatggctgacattcctataacaaaagacagattaacaaaagaaaagtggaacaaatttatttaatgtaagttttatgtgacacaggagccttcactcaaaaaccgagtgaaaactacttttgtggttaggtttaatgaatgatggacagttgtatagaagtatgattgaacaaaaaaggcatatgatctaatggtaataaactggggaaaacttagcaagtcctcagattcttctcagcctctctgtgtaacatttcttccttctgattatatggcaggtcacctgtcacatgaggatcttcaagagagagagggtgggagaaggtcagagggacctttctgtttttgtggttttcttaattgccttctgcttaaaatactcagtatgctgaggggccatattttggggtagcatttcctgaactgcatcagcatctagcatactggtgtgtctatttctcatttctcggagtgagcattgtggctgagccctgccatttagtcatcaaatgttgaagcagtctttcctagccctctaaatgacattcaaatgggtataagcagttgccctgaatgttaacaagataagatcattctgagccctaaaactactaagactaatggtcatttgcatatgtttattctttaaaaattgaaactcagatctggaacatttgcgttcactgtaggcctgaatgctgataaagctaaccattttggggtggttgtttgcttgacattgattgtatttccctgaaggcaacaattctcagctcttagcctttctccattttgtgtttcaaggctgcttaattccacatggctttatagtgtcaatgaacaacacacttgcagtgataaatattgtaactcagtgatgaagtttcacagatattcttggctatttacgtcttgtcggattctcaggaggccatgcaaagggttaatacttcctagagtagaaggatacaataacctttatttacattacttcacaaattcataattttaattaaaatgagcagtggtatctctagtgacagactctctccattttagatttatttaggcagtgattagctattatgatttcttgaattaattagcatctcttgagctacagggaattagtgaattaataaaaactcatggagaagctcaaaattaacacaaaaaataagttaaccccccccaaattatccactcctcacttaacatacattgatcaatatacttataaatgcaactcaaatcctttcttattttgaaatattgggattttgttttcatgagaagaacaaataaagctatgtgtgaacttcaaggttatatctccctgaagagcgtctaatttagattacctaatagatcatctaaacacaccaagggcctgatttgatctcacttataccctacttataaagtcacctgataaaatctgattttctcatagtgtaaaccaggaagcagctgagtgtgacttgaagtttaaaacatggtacccacatatacctggaatatactaggaatatatcctgtcttctcaggaaccatggtaatgtgagagaaatgaaggtttagcgtcatatgaaataagaaaaaggcatagtaacgtgggtaatctagactgttgtcagcatatcctgtttatttcctgacagatgctgggtttaaatcttgtgagaaaccagatctgtggcatatgtcatagattttatgttagtgcttgtggcgcattatattagctgacttttgtagctgctgtggattcattaagttatgtctgtaccattttctccatactggcttttctttcttcttttaaaaaaaattacacttgattttcatactgtgaatcaaaaagactctgtaattgaaataatagaaagtgagggtgagtgctgcattgtctgtgtgtgcttgtgcctggaggtggtggctcacacattcgcctctccccagagtgccgcctggatcatcaccaggaagaggcagctgtggaagagctgtgctatagtgtgtgtatccagctgtgtcacttactggctgtgtaatcttggaaagatatttaacctgtctgaccgccagtcctcagttgtcaaattggggctagagtagtatcgctgtgaggattaaattacataatgtatatgtagcacttgacaaataataataataattaacatatataactcttatgctaggcactgttctctacatgttgtataatttacttaatcctcatgattctataaagtagttctaattttatagaaattgaggtaaaaagaggccaagagtcccaagaccacagctagtacatggtggagctgggatttgaaccccagaaaacttgttccagagttcacgctcaaccagcagtagaggttatttttattaccctttgcatttggtctgtgctgctattctgaaactgtgttttgaaagtggcaatgactttctcttctttgacaccaatgtgctgtttcaatctgttgtccactgtctctttatttagacttcagctcacttacttccacagttcgggcctctaacacacacacacacacacacacacacacacacacacacacacacacacccctctccaccccttctcaatggcaacagctccctccacctgaaagaattggctgcaacaggagtcaaggcagagtcaagccagatgtggtaggcttacgactgtaatcctagcactttgaggggctgaggtgggaggatcacttgagaccaggagtttgagcctgggcaacaaagtgagcctgtctctacaaaaaatttaaaaattagccaggcatggtggtgtgtgcctatatagtcccagctaccaaggaggctgaagcaggaggatcccctgagcacaggagtttgaggttatagtgagctaattgtgccattgcactctagcctgaatgatgaagagagaccttgttaaaaaaaaaaaaatcgactcaggctcaccttcacttctttgctctgcaaacaaaccttccccacctggcccaggtaacaccttctccaagttgagcatctctctctgctgtcagccagccacaggcttctccatggggaaggaacagtgggaaggaaaatgggtgtctggacactgagaggcagaatccacagtgcttggcacctaactatgggaggagacaggtactacagagagagaagagttaaacatgactccagtgttttcagcatggaaacagggctttttggaaaatatatattggagagattaagagcgtagggtctaaagtcaaattgtattctagcactgctaattagatttttggccttgaacaagtcacttaacttttctgagcctcaatttcctcatctgcaaaatgagaataacaatgcttctataataataactagttgggattaagatcaagtctgtatgtaatagaaaaccccaaaaacagtggctttaaagagttaggcttttatttttctctcacttgaaatcagctgggagttaagccacatatgtactgctggtgtggcagggccacatggcagccacctgggctcctgccctcaggctgccccactaaatacgatttccattccgtggaacctcatgggccaagatgactgctggagctctgacattcacatacttattttagttagagagaaagagaaaaaaatgcaagtctccttactttaagactctctgggccaggcacggtggctcatgcctgtaatcctagcacttttggaggccgaggcgggtggatcacaaggtccagggttcaagaccagcctggccaacatggtgaaaccccgtctctactaagaatacaaaaattagcctggtgtggtggtgggtacctgtaatcccagctacttgggagggtgaggcaggagaattgcttgaatccaggaggcaggggttgcagtgagccgagatcacatcactgcactccagcctgggtggcagagaaagaccccgtctcggttgggggggtggggggcggggcggggcgggaaggctttctggcagtttcacacaacgtatcattagctacaactttatcacatggccacacctagctgcaaaggaagctaagaaatacagtcctctgactgggcagcagtggactactggggctctatccctaagtaaaggggagagtgtctggacaggaagcagtctgcatcatgctactttatagtgtgactgagagaattaagtgagatacagaatgaaagctcagcaaatactagtgataagaatagtattatcaaataagtagtatcaaatgacagtgatgaatactataactcacaataatgatgccatccaaagaaatgtaagagtcaggaaggagaaactgtagggccccggggggatgaatcacaacagagaggatcttgaggagtagctgtcaggatccctctgaaccccagggctgatctgtggcctgtgggatgagatgaggaaagtaaggacaaggtgggagcagtagtgtggccatgttgacacctttccgggtctttgcctaagagctgtggtgacttcctggttcagtgcaaagctcccagcttcttgcctgctcttccagtctctgctgcttccactgtggcgcttccacaggctctggtgcagaaggaaatctggctctgggtcagttagaattttaattaaaaatggaaatgcaggctcatgtcaccagtactacattctttcagcccagtgatgatttctggcagggataaaaataacagacatagccctttggcactaatgaagaaaggggtatatgtgtgggtgtgttttaatgaattaaaaatttataacagaaaatttagatataataagtcatcatagattctgttggtcttatgtgcttttgggcatatgtgcggcttccactgccttcttagtattttaattcggaactttctagggtcatcaaatgcataatatttagctgtcataccaggttagtgaatggagggggaaatttcataatttatttttagtatgaagggctatttaatgattttttgaaataatagttttatttaaaagcccacattttagtgaataatgagaatttttgcctttaaaagaggcccaaagcttgaaccttcaggctcaagcagtgcttcacacacacatacagaaaccctggcttcaatcccccatgtcatgggtcgaattgtgtcccctcaaaattcatatgttgatgttctcatcctcaatatctcaaatggggccattacagatgtaattagttaagatgaggtcatactggagtaggatgggccccaatctagtatgactggtgtattttaaaatggggcaatgtgtacacagacaaacagataagatcatgtgaagactggagttatgctgtcttaggccaagaactaccagcagctaggagagggacctggaacagatccttccctagtacttccagagggagaatagccctgccgacatcttgatcttggaagtctgtccctcagactggagacaacaaatgtctgttgtttaagtcacttggtttgtgatactttattatagcagccctaggaaattaatacactccatgactgggtagttacaggaccttaaggcatttgatattccaagactttgtttcctaagctgtgggatagtaatattcacccatctaccagtgaggatcaagtgtacctgtgaatattgtagagcaagcttgtccaatcctcagcccatggttctcatgccacccaggacagctttgaatgtggtccaacacaaatttgtaaactttcttaaaacactatgagattttgttttgtgatttttttttaaagctcatcagctattgttagtgtattttatgtgtggtcgaagacaattcttccagttggtccagggaaggcagaagattggacacccctattgtaaagcatcactacaatgtcaagtattaatatgacaccataaaacaatcactacaatgtcaagtattaatatgacaccataaaacaatcactacaatgtcaagtattaatatgaaaccataaaaccatactgtattttcttccctccctaccttcctttttctctctttcattttattttttgtttaaatatgtgtcataagggtttatgttaaattcctcctcctcaaccaactgcacagtagtaaaagtggggaatttctgtaatcatcaatgatttgctggcctttatagaggacttcaggaactaaatatatactgtacattaagatttcttggtaacaagtatctctccatgaggaacaaattatagaatgagatggccaattagtgtcatcttgcatcccagcactgatcaactgatcacctccctgcaatgctgtgttaaggaggattctgacactgcatctaggatagagcatcatgatcgcttagtgacatttactatgggtctgaactggatcaattgtagctcatacttttgtggacctgcagtttacatttctttttaattatgaccaagttctttgttatgtgaaaatctttattcatggcaaaattcatttagccaatgaaagcaaattggcatatgttcaactaaatcagctgtagcctaaaaatacctgagagctaaaataaaagtagtagaataaatttggagttgtctgtgtgaggagtacagataataatattaacagtaagatttatttaaagcttactgtcagatgttgtgcatctgacatggtgaagtgtactttacttgcataatttcagtgaatcctcactgctgccatatgaagtaggtcactactcagatgggaagctgagtttcttataaatcaagtgatggggggccaggtgtggatcacatctgtaatcccagcactttggtaggctgaggcagacagatcacttgaggtcaggagttcaagaccagcctggccaacacagtgaaaccccatctctgctgaaaatacaaaacttagccaggtgtggtggcatgtgcctgcaattctagctacttgggaggctgaggcatgagaatcgcttgaacccgggaggttgaggttccagtgagccaagatccaccactgcattcctgcctgggtgatggagtgagactgtctcgaaaaaaaataaaaagaaaataaatcaagtgatggactttaggcctcacagctggcagagctatcatttaacaccaggtctgtgacatatttcaatgtctgctctgacgctcatgatgctagagtgtgcatgcgtgaatatgtgtgtttgaggtaaaattcacataaaatattaaccgtctaaaagtgaacaattcagtggtatttagtacattcagtgtgtgcaaccaccactttgatctacttccagaatgttttcatcatgccacaaacaaaccccacatctattaaacagctactcctcatttccttctcccctccagcccctgacaaacagcaatctgctagatttacctattttggatatttcatataaatggaatcatacaataggtgactcctttttcttagtaaaatatttttggccaggtgcagtggttcacacgtaacactttgggaggccaagatgggtggatcatttgagcctgagtttgagaccagcctgggcaacatagcaagacattatttctgtgaaaaaattaaagcaaaatataatgtttttaaagttcatccgtgtatcagtaccatgtatcagtatttcgttcctctttatggctacataatattgtggtgttgttgttgttgttgttgttgttttgagatggagtctcgctctgccacccaggctggagtacagtggcacaatctcggctcactgcaacctctgcctcgcgggttcaagcaattctcctgcctcagcctccagagtagctgggattacaggtgtctgctactatgcctggctattttttgtatttttagtagagatgagatttcatcatgttggccaggctggtctcgaactgctgacctcaggtgatcctcctacctcggcctcccaaagcgctgggattacaggtgacagccaccatgcccagcccatactgtgtatattttgaggcagaatatcaacatcctatgtacctttttcacctggatatatgaagaaaacccaagtctggctactcagacacctcctccatttccccatgtcattctccacatggtgacatggatgaccacactgctaaaatatcaggtgctctccctctccctggatatggagtgtttggacatggtcttctgccctcctgatgcatgaggccaaagcgcccacaggctctagatgtaggagagctggctatagcttagtatatgtgctttccctaatccacttctaatttggggtagtagttttgttatctggctttttctggctacccagaacattccatcttataggggccaagtgtttctgggtgatgattcagatctctgctccaactagagcagcagctttcataatactctccctggatctcatcacaaattatcctgcacaaaacagtcagtgtgatctttctgaatccctaaactgatcaagtcatgccctactcataattattctgtgtcttcccagtgcttacagggtgcactaaaactctgtaacacacaaggtcatgaaggatctgcccctttctatgtaataccattctctcctccaaactccctgcacattctagaaaaattgaacaagtgatgcttcccctgacttccccaggaggactcagaggccccttccttcatgcttttatgtcagcgttgtgccttttacagaactttataataatggggagagagggagcatgtcaagccatcctggaattatttgtttctacgtctgtctccccactcaaactgtaaattccttgagagcagagaatgtatctttactgcttcatatccccaatacctagcacagttcctagaacatggcaggaactcagtaaatatccattccttttgaagaaccacgaattctttagaggaagtgatactcttaaaattatgcacctcatggccgggtgtggtggctcatgcctataatctcagcactttgggaggccgaggtgggtggatcacttgaggtcaggagtttgagaccagcctggccaacatggtgaaaccctgtctttactaaaaatgcaaaaattagccgggcatggtagtgggcacctgtaatcccagctacttgggaggctgaggcaggagatcactggaatctgggaggtggatgttgcagtgagctgagattgcaccactgcactccagcctgagcgatggaatgagaccctgtctcaaaaaaaaaaaaaaaagaaagaaagaaaaaaattatgcacctcatataatggacctagatagaagttggatgttagaactcatgatctttggacagtctctccaaacgacaaacataatgataaggaagagaataaggggtggcaaaagtggtcagatacaccttcctctctcaatatacacacagtatcccagaacacaactgaacatttttttttcctttgagatagtgtcttgctctgttgcccaggctggattgcagtggcgcgatctcggctcattgcaatctcaacctcccagggtgaagcaatcctcttccctcagcctcccaagtagctgggattacaggcacgtgcacacccagctaattttctgtatgtttagtagagactgggttttgccatgttgcccaggctgatctccaacttgtgggctcaagtgatctgcccgcctcgacctcccaaaaaccgaaattttaactgtaagaagaaacatgataggattgttaaattgatagctacgtggttagctgtggattcttttttgattgccttaaatacatgaaaagaatgtcagaatgaatccttcatggcaatctcagtggttattcctctccaaaagcttctgcccattccttttcatctctgccttcccttatttctcaccaccagctcctttatcacgtggtttagaattccacagaaagattgaagagaagccacttctgaactctggattataagaaacatcaccatttgaaggctgccttagggaactatgcagagatgatgggtaaaaatcgagatgtggaaaagttcaaggcctgtgaatgcaactttacttcctcactgtaaaataaaattaggttaaaatcaaggtgttggcagggggaaaaaagattaggggcacgtctcacagatgttaattttggccacgtaccttaatgtcttaatacattaatatgatacatacattaatagcttaatagcttcacactaatagatcttactaaagaaaaatgatttaggatggtagtaagcagaagaaatgattggataaatttgaatttgaaggatttttgcctttagatgtttccgtggaagatattttctgtaaaggtgatgccttaggtttatacttttccaaacacaggatattgctaggccacatatataaagaaaaggccaaaaacatattaagaaggaaggaagggagaaaagaaaaaagggaggaaggaagaaggaaggcaggaaggaagggaaggcagggagggaggaaggcaggaaggaaggaagttagttatattcagaatgttcattgtgatggatgagaatggaatgctcatgaagtgctcagctgggctgaagtcacaggtccgcaggtatcaagagcagtggtgactcctgtgagtaaaaagactaacagggctccaaacaagataggattcagagttgagactcctacttgaagccagtaaatgaggtggttcatttaggctgataaaaagcgtctgggaaaaagaatggggtaggggagaggttatgtgatcctgtgctctaactgtagcaatttcttccacatattctccatcgtctggggtgatgctgaccatcacccaggactatgacttttagccaccttctggctgaggatggtagaaggatatataagcagccaggcctgtggctgccacagtcataggctcttccatatgcccaataagaccatgggacagcagcacaaaatgccattctacaacctggctctgggctagagacccagagagccaagcagacataaccataacattactagaataggagggtgggcaaaggggaagtgagagggagagagaaaacaaaatcctcttcctcctcaccctttcagtgagcctgccaactgaaatttcagaacacctgaataaacctaaagctgaggaagacaacccaccaaaacaacaaatgaagcataaattcgtttgaaatgaaactaaattcatggaatagtctgaaggattaatgtagataactactaactgtaagaaggaaaacaatttgggataaaatacgtaaaaactaactctaatcatacagttggggcagggacagcatccagtgtgtgatttaggcatgcacaagttgtttttctttgtttggttttttgttgttgtttttgagatggagtctcgctccgtcgcccaggctagagtgcagtggcatgatctcggctcactgcaacctccgcctcccaggttcaagcgatcctcttgcctcagcctcctgagtagctggggttgcaggtgcatgccacaacacctggctgatttttgtatttttagtagagacggggtttcaccgtgttggccagactggtctcgaactcctgacctcaggtgacccgccctccttggtctcccaaaatgctgagattacaggtgtgagccaccgtgcccggcctaggcacgcataggtttttgtactcagaaaggggatagaactacaggaaaattgacagttaagcaaacatgttaaactaatttgtagttaagcaaatatgttaaaactatagaaaaacaatgtctagtttctaaaccaaaagaagaaagggtctacagaaaatttaatcaatctaacagaagacaggaaatgaggaaaaaaagcattggaggaaaaggttggtaaaaagagatttctatctatatgaccatgcttttgaattatcaggcagtcagtttttcccaagatttccagtacataagcagtggtgtactggtaaatgtttaaactggctggttgcggataggggtgggagtggggctgattttcagtgtttactcgttttcatggtgtaaatattcccaccatagccaatttcaagctatcaatctgatatcaaccagctcacagaattcctgaaaatgttaacagtaatgtctagtaagcttatgcatgctggttctaggatactattgtttactcgtttgggatagacaggatttcctcatagtcttcctactgcatataacttttgacaataaaataaaaagattcaacaatgagataccactacatacctattggaatgaccaaaatctggaacactgacaataccaaatgctgccaaggatgtggagcaaaaggaactctccttcatttttggtgggaatgcaaatggtatagccactttggaagacagtttgctaatttcttacaaaagtaaacatatgcttaccgtagggtctagcaatcgccctttttaatatttacctaaaggaattgaaaacttatatacacataaaaatctgcacatgaatgtttatcacagttttatttacaagtgccaaaacttggaaatcaccaagatgtccttcagtaggtgaatggatgagtaaactctggtatatccagacaatggaacattattcactgctaaaaagaaatcagctatcaagccatgaaaagacatggaggaatcttaaattcatgttaccatgtgaaagaaaccaatctgaagagtctatatactgtaggattccaattacgtgacattctggaaaaggcaaaaccatggagacagtatggagatcagtagttgtcaggagttgtgggcagggagggaggggaagaacaggtggaacccacaggatttttcgggcagtgaaaatactctgtataatactctacgaatggattacatgtcattataaatttgcccaaacctatagaatgtacaacactgagagtgaactttaatgtaaaccatggactctgggtaattacgatgtgtcagtatgagttcctcaattgtaacaaatgtacaggtgggggatgttgacagtggagaggctgtgcgtgtaggggggccggggtatatgggaaatctctgtacctttctctcaattttgctgtgaacttaaaactgttgtaaaaataaagtctttaataaaataaaacaaattctctgcatgctacttttctaactgaaatcataagggaatttattatgaaaacaggacttggtggcattctcttattagagtattcatcatatggttatggaaggctagtaatttatgatccttgctagcaaagccagatcaataaagagataaatgtcctcagcacaatagaatttatatcatccacatgataattgaccactgtgtcacacattcaatcattcatcgcattatctgatataactagcaggaagggtaatatgtctatgatttattattaatgcatactagtatgaaattcgtgatccatctaacctgttacctgtccttggcaacatagtatgtacagttgtctacttccagtaataggatcccgcagaaagaatcagacaaccctgtttaatgctaggcattgcctgttgaattggaagagatccaagaagtgcctgagctagtgttactccctctcttcttttctcttctcttccctttctccttgtcatcagttctggttccttttttttgttctgttttgtttttctttccccagagcacagtggcctgtctagagcagagatgggtgggtaagtggtcctaaaagatcctttgatgtcactgatttgctgctatgagtatattttgtgacagtcattctgtatcacctatctatgcatgtcagtgaattaacagtggcttcaagctcaggacacaccataataccagggcggggaaacagcaggtcccctggggaaacagaatggagaaaattagaaaggaaaacagaaagataaccattcagaaacccatgcatagagttagttccctaacaataggagtcaaaagtattccaaactgtctccccctcccccttctttcccaacctcttgggaacatgtgttggttgcctgcaacgtctgtgctttactttgcaagggttaattagatggcctattattcagcaaattaaaggcttggttgcctgagttcctttcagaaaggattagggtctctgatgaggctttgatgtaatagatggagctgttctgctccatcttgttaatggaggagttttaaggactccccagactctatttggccgtcagtgtctttattcattccctttcctaaagaagaaaaatattttatcttgcaaaaattcagtgcttgaacaaggcactggattgacatcctgggggtggggtggggggtggagggtgaagtgttcatttcttgtctaaaatcacacagaagcagcacttcctggcttccttgggtggccacttcctctgcaaaaaccatctctccaaaaaagcagcaggagcagtaatttaggccttgtggttcattgtcctttgaagcttttttgctaagaagttgggcaggagagatgacaggtgacaggcatggtagtggtttgtgtcctcaggaacatgaaccaagacagccaataactgcaaaatcctaccttgcataaaatgtgtgcacctacatattatctgacaagatttttttccagactttttagtgtggttaagttgttatgaaaatctggcttagttcattttctccaatttgatgttcacataattggcagtcagccagagaagtgtttagtcaattttagtctttaccaaaagaacaaacattaagggaagggtacaaaatgtgggtagacacaatgccagtacgactattgcagctctaggtcattatcctgcctctttatctaatctcctagccccactgtgtattatggcctgacattttagctggagtaattattgtcatcatttagggagcaagtcagctgtccttttgttgccaactcccacttgtgtgatgctccagtcttattcctgcccttccccaactcacattgttgggattgaatcgctccctcctttgagttacttttgattcatgggctcaacattttcagcaatcttcttttcattctttgcaatgaatagcacatggtagcttggcatccaccttttctttccttaatcaatgccagcatccagacattcaacgtgtcaggaatcaaggggcctgaccctataaaaattcaccaagttgctgatagatttagcaatggattaagacagatggctcttgtctctttgtgttggccacccagggagaattttttttactagatgatgtaaggcatcagtttatttatttatttattatttatttatttttattttattttattttttgagatggagtctcgctgtgtcgcccaggtggagtgcagtggcgtgatctcggctcactgcaagctctgcctcctgggttcacgccattctcctgcctcagcctcccaagtagctgggactacaggtgcccgccaccatgcccggctgacttttttgtatttttactggagacggggtttcaccgtgttggccaggatggtctcaatctcctgacctcgtgatccgcccacctcggcctcccaaagtgctgggattacaggcatgagccaccgcgcctggccaacaggcttcggtttacattgaagagtgtcataagaaacagccctattaaacccatagctgcatttactagagagtgataatattcattacatagcatggaggcatttcttttctttttgagacagattttccctctttttgcccagcctggagtacaacggcatgatctcggctccctgtaacctctgcttcctgggttcaagcagttctcctgcctcagcctcctgagtagctgggattacaggcatccatcaccacacctggctaattttgtatttttagtagagatggggtttcaccatgttggccaggctggtctcgaactcctgacctcaggtgatccacccacctcagcctcccaaagtgctgggattacaagtgtgagccaccgcacctggctgcatggagccatttctatgaaaaccctggaaagctatatctttagtcttgttacctgtcattacatcacagttctccaaattgctggtctgttttatttatttatttttatttttatctttaaaaaaatgttttaagacaaggtctcaccctgtggcccaggctggagtgcagtggtacaatcatggctcactgcagcctcaacctcctgggctcaagcagtcctcccacctcagcctcccaagtggctgggaccataggtatgcaccaccacggccccctgatttaaaaacaatatttttggtagagacagggtctccctgtgtggctcaggcttgtctctaactcctgggctcaagcaatattcctggctcagcctcccaaagtgctgggatcacagacaggtgtgagacactgggcctggcctagtctgtttttatatcatggattttaagaaatatagaacagaattcctgtctctactaaaaatacaaaaattagctgggcattgtggcagtcacctataatctcagctactcaggaagctgaggcaggagaatcccttgaacctgggaggcggaggttgcagtgagccaagatcacgccttgcactccagcctgggcaacagagagagactccatctcaaaaaaaataaaaataaaaataaataatatatattatatatatatattttatatattatatatttatatgtgtattatatattatattttatatatatgtatataactgactacattttatctttcacattgtctgacagaaagcccagagccccatttgtggacaccgctaacaaagtcttttatttggtattctaattcctattagattccagggtatctttcttcccttatttcccctttgcttcatttttctgtttggtttataattgttttttatctttccttatcacatatacctttatttatttaagcacctattgttttaaggtgtcttaagttatttctggaacaagatggaatattttaaaatttgcatacgttggtaggaatataaaatgatgctatgattttggaaaacagtctggtagttcctcaagaagacaaacataaagttaccataaccagcaatccaggggaaatgaaaacatgtgtccacataaaagcttgtacagaaatgttcgtagtagcaataattcataatagcttaaaagtagaaacaaccagctgggcgcagtggctcacgcctgtaatcccagcactttgggaggccaaggtgggtggatcacctgaggtcgggagttcgagaccaggctgaccaacatggagaaactccgtctctactaaaaatacaaaagtagccaggtgcggtggggagcgcctgtaatcccagctactccggaggctgaggcaggagaatcacttgaacctgggaggcagaggttgcggtgagccgagatcgcaccattgcactccagcctgggcaacgagagtgaaactccttctcaaaaaaaaaaacaaaaaaacaaaagtagaaacaacctaagtgtctatcaactgatagacggatcaacaaaatgtggtatgtccatataatgaaacattatttaacaataaaaatgaatgaaatattaatatatgctgtgatatgaatgaaccttgaaaacatgcaaaatgaaagaagctagtcacaaaagaccatacatattatatgaaatgtccagattagacaaatctacagggacagaaagtagattagtggttgcctgggactgaggaggttgagggagtatagggtgtgaatgctaatggatacggggtttctttttggggtgatgaaaatgttctgaaattgattgtggtaatggttgcacaactgtgtgaatatattaaaaataattgaattgtacatttttaatggatgaactgtatagtatgtgaactatatctcattaaacctattataagaattattagcaataatcagttgaaaattttattgagtagtttttgctgattttcttgcatttaaaatttttacttaatgccagctatgcacattatagttgcaaccactcattttgagcagaatctacagacttgtttgggattgtgggtctccaagaatagggacggccttctccgtagtaggcaaattccctctatattacttaatttataaatttgagctactaggcaaaggcagtagttgttcaggagcaagttctaagcctgtgcacataaaagctatcagttctattttcgcttctccttgtctttgcataccctatctcctctgcccttgtcatcttattccacctggtaatgaaaataaatgagcgagagtagtcagaaaagtaaaagaataactaagagatgtagcatcactacaggcaatgaaacagaatgtttcaagaaaccagggtaatgatggtcattagtgacctcttgaacagagaggttgaatacaatgagaactaaaaagggaacacagaatcggcaacttaaaggcctttagggtcctttgagagagattttagttgggtagtgaagataaaagatttttatgttcacaaacatttagctacaggcccatctattaaatttaagtttgcctaagattccattggtgacctcttctcttttctttcaacactcttgacttgtcttcaagttccagggctacaatcatcatctttccctttctatttcattaattcagactgtattcttcctaaatgaattcactccttccctctaatctactctctaatgtggtgccactttattttctaaagcaaatatctaattgtgttatatccttgttcatgaacctcagtttaatgtggctaagaaagcccaaacttaccagcaagaccttctgggttctgaaaagatgttccagccagactctcaccccatctctattataactgcattgttctgttctactcatatccctagatgagccttgcattttataccaatgaacttcctcaaaaggctactgtaccctccgcttggaatgcctcttgcctgcattttctgtcaataccccttttgttctttaagacccaaggatcatctctcatgtgaaactcttgctcctagttagaattatttacttcgtctgcgctattctagtgcttatacttttcagccttaaattattattatttatgtccatgtctattctaatacttctttctaaatcccatgaaagcaaatgtctcattccaggcattgttttccctaggcatttgctgtggcaccattcacagtaaatacctagtaagtttttgaatgaatcaatgaaatcaatctcatctgattctctaaatctttcatatgtgtaagtttggtattaccccagaagctgataagtttcttgtggatgaatataatgtcttctgtttgatttgcactctcttagccccaaccccagttctggtatagtcctgagcatgtaatgatcatgcactgtggaacagattgttcatttctgttagaggatggctgggtactctctattccttctccttgtagggagaagaatgcatacaaatgagaattgtggatttaattcagggaagggtggcaagtaggatcatgggaagaaatacaattcatgtgtccctgggcatttaagcctggactaagaagcagaccatgactgtttgtcaaaatggaaattgattttcgaatcaaagaaatgagccagacattaaaaaaattacccaaaggcatgaacttgaaaatgccaaagctctttgcttttgctgaattgccagaccccagaaattcccttcccctcagaactttgaaagttctgatcagggcatctactatcaaacagaaatttgtcctcagtggtaggaatcaactgagagaaagtagctaactaatgagcacagtattattaaaatctaactgagggagccattgcacattaacatttccttgttgctgtggtttgaatgtgtctcctccaaaattcaggtgctggctttgtgatagtattaagaggtgggttctttaagaggtcgttaggtcatgagagcctctccgtggtgaatgggattaaggattaagtactggataaacaggcttgaaggagaggcagttagtctcttcttgccttttggccttccactgtgtgaagacacagcattcctctcctctgaaggagccatcttggaagtagagagcagccctcaccagacaactgaacctgctggaggcttgatcttggaattctcagccgtcagaactgtgagaaagtacatttctgttctttataaattacccagtcttaggtcatctgatagagcagtgcaaaatggagtaagacacttatgtagcactcatactgctaattatcaataggtgtaccacagctatcttcctccaatggactgactgactgtatacccagcaactagtacagtgtctggcccagggagctgacatttatcaattgttcgctatataccaaatactagacatgaattaactcatttattccccacaataacctttctaaccatttaaggtgtgatctcccagggaccacaccttctccagccctttgaactaaagggtggcatttgaacatagactaacaatctgataagctagttgctggggctgtgtttatctgtgccctgactgtgtcacatgggtggagttgcctggagaaatatctggttaattgcaaggtgctttttataaaaactcaaccaaagaaaaaagaaagccaggaggagggagaaggtgatgacttggggccaccagttaacaatccttaagactgccttaattctcggacacaaaattgacatcttcttggctgccactgtgtccagcagagggcaaccttatccccattctttgtcaaatgccgtaggacagtttgaaagcgtagcttaaacataagaaggaggtgccaagaacaagaataaaacagccaactcggtcagtatgccttcagtgactttttcttggagatacctctctttaccttgaatctgtgccccatcttgacctgctacttggctctggcctggttcacttggcccttctaacttcatgtcatttgtttagcacttttacatctctctctctttttcctcctcccagactgattctgccttttgtctatagtatagtctcctttcctctgttcctcctcactgtggctctccacttgtccccagacaagcagggcttgaggatctagaatttttgttaccacatctccttccctaagaacatagtcagttagtctgggcttttcaaactatttcatattgaccaagggcttagagatagagggtaaagaggttcctggttgacaggtttcactgaggctgcaaccctggggcattacagggttacatattgcagctctctgccttactgggggtctctgatcctgggccttgtttttgcatagggactttctccagccacactggtgcacacgtcttaactctagaggtagattctgtcccatttgctcagagatgtgatattttggcttcaaaccaccaccctatatgttttcttttgtcaccttctttactttctttgagtcttctctgggtgagaaaagtagatgttctttatccccaagtttcctgcccagtgtcaggcttcaggaaatgcaatgttcttccctttccatttccgtcctaccttcacttgagcttactgtggacctttggtgctgacagctttgtctaaagatcaggctcacttgtttatctttccaaccttgccccaggatctctggcaagatggcagctgccctgtcgtccagtagccatgtggtctcttgctttttacacagactctattcccgttactcatttcaaagggagactcagcttcctgttcaaaagctctccatcctaccttcttggggatttttgtcttttagcaaatactgactattctcctctgattgataaccatagacctgcctaactgagtaatgcactcccagttctcatttacctgtttcaggggaggaccccacttccccaccccaaatgtgaagttagcatgcaatttcagttctcaccagtgagactttgcaacagcatcaaatgtgatattcagacttcaggaaaactgaaatgcagttaaatattccaccaaacaggggggtgatgtttcacagaaataccatacacagcatcaagtttctcattctgccttcttttgaggcattagtcattttgagaaaatgcctgtttgtcatagtcttgtcttgcagaatggaaattttcttccaaggcagaatactgtgtgctctgatatttaacctataattagtgtatcctctggaggattttctccccttgatttagaggcctctttgtcagtcagccttctgtttgacgatgatagcaaccacagggcagcacagtgaatcacacggcagggaaatgcttgctcagatccaaaatgtttagatcttctgtagcaatgggaacacataacaattcaagtagcaggcctgcaagaaaatagcaggaagtataaaagacagaatatttataaagaaatgagaagagtcataaatcctgagttttgatctagttttgccccaatgtatggaatacattgctcaccctcatgcttttcttacccagtttactagtatttttagtttttgccttttcagctgctctatatcaagtgttttattcattggtaaacaacagtcagaggctcttgacaaatagctcccccttgcaggcatccggttttttggttatgaaatggcagtttacaggcacagagtagctgtgtcacgacagcattattgtcttggagcagagagtgcacagacaccaccagcttgagagcccgaccttgtttcttgctaagaaatgtcccgtttttgcctgtttttggcagaagccagactgggagattgctgcaaatggctgcaacaacctgtgtttaatgtggtgacactaatagattctgagaattaatcttcagccaagaaagcatgatggaaggtactagaatttcaaattagatagtggattgatttccttcaaggctgaaatttgcttcctttatcttctggtggacttttctatcatattcaaaaccacccatcatggccttatttccagagtctcttgcatatatctcatggtataaataaattgttattctgttgttttgtctgttagcacagagaaagcatatctaaatcctaattttttaaaaaagattaaaaaatccaggaatgaatgaaagaaagaattacttatgatttggggaaaagtagtgtatctaaatctagtccttgctacttgttttctagaataaaggactctggaaagaactgagctcaggaaaatatctccccaggttgaaacactgtcttttgcagaaacaatagccctccagagtgtctgagatgtggcaattattaagagttcttacagtgtcccctcagtccactgagttgaggactctggtgtccattctaaaatcatgcgactaattgcttacaacagaacttccaaggatatcatttgtggggcccaaacaaacaaacaaaaaggtctctgtggctaagtaagcttggaaacgtgggctcaaatagaattaaacttttttttaaccctagctcttgtaagaacctttaataggcttgtgtgcattacaaaactccaaacttacttggtttagagaatcaccaatgttttccaaactcttttgactaggaaactagcttctttttttgatggaatgctttatgtgtctagtgcttcccctaattcacctcatgttggctggcccccaatcccatacagagtttaacattttatgcatccttttgtaaaaactgctcagtccctggctgggggaagatagtcttcttttggaatttgcaattcctggtttaataagcaatacctgaaatgaatacgtttcttagaactcctttagttctacttgtttgttctccaaatcaggttaaaggattctatcttgctttataaaaggacatggaggctatcaggagttttaggaatcccagctgtcagtttcatcttcatccactaaatctctgctgaccagggatagaaatgacaagccgacaaacttaaacagtaagaattctgggcaccaaactacaaagtcttaagcaacaacaattataccttagttaaagttggtaaagggactaaaggcagtaactgttgttaggcattcaaaagaagcagcttaggaggtgaaggtcagtgttctggtggcctcctgacttactggctttgcagcttgtctagtctgcttcttgcattgccggtctggctccccagtatgacttctgcctttactcccccagtttagttcaatttagttccaaaacttcccccaagacttacctagctcaattcttaccagctccaggaagtcttccctgactacagttcttccctctggccgcgaagtattgtttcgtacgttgtacctttgtcatttttaacaacacggaacaaagcaggaagggtcctcctgtgggagttgaggaattgacctcatcattgccaggacttgatcccatttcctcacctcttaaaagaggggctagaatcgaaaatctcagtccctgtggctctgaaaccctatgcttttgtgctattatttcttatcctaaagatagaagcaaacatatggcttttgctgtttcttgtgcttctcttgtccttctgtctttccaattagattgtagatccttgaggaaaagggtcatagcttttaattaatttatgtattgtggctagttctagtgctgagtaataaatgtttgctgagtaaacgatatgatgctatgccctcatatccagtaacgcaggactttctatctgctcttaaggcataactttcctctatttatctgtaaaataatagttccatttcagactggctctttgctccccatgagaaaaaaatatagagaggagtattttagaataaagctataccttcaagttcttcatgccctttccctaaaaatcctccaatgcagttggagagtcacaactctgcttagccttcttcctctttacactcaggttcagttgtgctgatcctgtggtatgatggtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtaagtttctcctaataaaaccctatatctcatttgttggctctgggtctctccttcagcctcttgaacttggtgccatccctactgaagttaataggggtttatcacgcagacattcaacccacttcagtctttctttcttacttggagaactaagaaagcacttttttttgtttgttttttgtttttgtttttttgagacagggtctcactctgttgccagactggagtgtagtggtgggatcatagctcactgcaatctcaaactcctgggctcaagtgatcctcctgcctcagcctcccaagtagctgggactacaggtgtgctctgctaatttttaaattatttttagtagagatgaggtctcactatgttgctcaggcttctcttgaactcctgggctcaagaaatcctcctatctgggctcccaaagtgttgggattatgggcatgagccaccacgcctggccaacagatcttcttgatcattgcttccagaaagtagaatgcctactatcttcattttttggatcttcaagaaataacagatttactcgttagtttcttctttgtctaattctctgacttcattattcattcatttcttttattcctccataatctagagagggaccctctctaacatatcaaatgatcttgcgaccgtgttggaagccttgcttctccagtggatgctaacattgtgaaacaagctataccacctttaattgtggtccctagactccagtggaggcatcttttcataaggctggatggagtatgggtttcctagtctttctcaatccctgttcaaggagctttacttactgaagtacccaaaggaccttgttttcaggcctcacctggaacactgccctgaggtacctatattaaggaggaaggtagagaggcagctccagctcactttccccttcacatgctatgaattttttgtgaattgcctccttccaccttcagtctctgcccctgtgtttactaatttgaagtgttgccactagtcaacaggctattgagggacccctggtccttttgttcattctttcttttcaatgagcatttcctggtagtcagatgacgcttcaacaattaacacaggaagaaagccaaaacaaaaatgtggggagggtgacggatgggtgggatgaatattatgtgaggaaacaagaaatttctctccccatgtttgggaaatacttcaatactgatatgcctatttggtgatgagaaacagacataatgtgacttattaagaaatcagtaagcaggcttagcttcagatccagcagttcctggactcccatcctacccgttccctctgaggttcctgggggtgtgcacaactaccgggtgcatcttcagtaggaactctcagaggacataggggctatgtttatcttaggagtttttatacactattcctaatgctaggaggactgggccatacacctatgttactgacagtataactacctcttgggttccctcttttttcaggaaacatggttattagcatttttgcataatatctaagcatattaactttgatagttacatatagagatgaatatacaaggaatcaagggaagattgctgatgtaaagacatgaacacagtcttcttaaagcatatgcactgattttttatttttcacagaaaaataatagattatacaaaaagccctgaacctataaaagtcaaatgatgtatttcttcccatggcaaggcagaggtggtatttatagtcctgcaagcagctgaatggagataatttaggttccgttggcttttctggctgaaagctccagttccaatagatagggaatcccctgaatcaattataaaatggagtaactgggagatttaccgaatatcttttcaggactagaaggtaagggatatgaaagtgttttgaactgaaaactgcagaaaccaaagcttttttgtaaatttaacttttgaggattgtttcaagaactctgcttaagtgttttgaaaagatgttcaaggtgaggctgaagttttttaacatttgtcagtgaatttcattaaaaatacgttgtatgttagatgctgctggcattccactgttgagaaaactaaagacgtttatttcatggattgggcagaatggcatccatttatcctaagcctccaatgtgggcttaaggacaagtggcttaaaagggtagatgttaaaatttcttcctctcgccaagggcaggtacgcagaatagaaatgtgatggcagttggagggatattcgtcagattcaatttcactagaaatttccctgtatccaaatcatcttgaataacacagaaggtgcagcaaaatgtactgaatcattgctttgaaaaggattttgaatctaaaacagaaagtagttatgccggtatgattttaaccaattaaccacagaagagtttaaatgcaacccaatttttatcatttcgaatggactttttgttccctgtttgtataattctattccaattcatctgaattatattgtactcacttcctgttctgtggtttttctggttcttcagaagacattagaaatcaagcgccagcgtttctgtgaaggtttctttatgattagtttttttccttttaacacctagatgccttttccctgccggtaaacaaggggcatttcatatattaggatttaattgaggtgatagtatttaattctacgtatttctaaaagaaagtatacatacaaatcaacttgactccactgaaaatatttttctctaatgaaaatgcggatagaaaattgagcagtctatatttttagtgttttgagtacttcaagttgatggtacaaattgtgttttcaactttgcttaaaacaaacgaagacagatttctgatgttttaattaattcaactaatagagaattactatttttctgttttctggtacatattaattaaagagagagctgtgtatcattaaccaatgatcaggttttataaatgagcttttaccttctctccatctcccatattcataggggaacagggtgtctaagattgtactttggattgtttgttggtttttgcaaacaggtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggtactgtactctctttcttctttctccctgtggttgtttataaaaatgtcatgtcatgtgttttgatttgcccagcattattactggtagttattacattcctgcatttttaagagttttatttacatgacattaagtactccatgcccagtggatgagagcaggagaacttcagaaacaaactgcccatttgtgctcttatggccaatttctctcaagtggctgaaatcttactctgccctggtgttcagttagctttagttaaaaaatcaacaaatatatatatttacatttaacagaaatttggattttttttttttttttttaccaatagaggtaaccgtatgaaagcaaccatggctgacattgtgtgaaacacctttacttggccattgtagactgaagagcagtaatgcaggctgtaaagtgattttggaaagattatgagctaaacaccgaaggctgtttctctaatgtgctctgagaccattttctctttagtttcaaactctttagagtcgatttggtatttttaagtaacatttttcaggtatttcttatgctatctaaagcaactgtgattcctaccctacctcatcctctttttttttagaaggtagatttttatacaaatgtttattttcaggggcaagtgctttaaacagtattccctggtaaatctctaagaaatagatcttcaatttctgtccagagggtggcagaatttctctttaaaaaaaattaaatgcaaataaacctgcttcctatgctcagcaattatttggttttatgaaaccatccaggatgtagataagctccagtccattattattaaaagaacattggaagtactggaggtgaagaaaataaaatatcataagttacaagttctggaaatattcatgtattctgcagaaaactgtttactaatcaaaaagccaaacattggcatccaaactcttggagctggaggcgtagtatcaaggtgactatattttgctgatttttctccaccaggttcccttttggatagctcagaggggattttttttcctacttgtttcctttttccactgccttttctgtttctatggcctccctacagagtagagaaatgcagagaaattcttgtgacttggggtctttttgaagcagcaggaacttgtgtttaagccccagggagctgaaatctcttttcttccttgttttggttcctatacaccagccaccacccctaccacccacctacacacacacacacacacacacacacacacacacacacacacacacacacagcaccaccaccaccaaaaatgaagacgaagtaaaagaaaatacaaaccaagcaaaaaacaaacccaacatctaaagggtatgagtcaaatccagcatctcctccttgtctccctgttctaggatttgccatggaatgatttctaagacttcatttgccaagctatctggattttcatatttgcctgactttgcctgtccagatctatgctctctctctctctctctttttttttctttttttttcaaaaagaaaaagaacaggccaggtgcggtggctcacgcctgtaatcccagcactttgggaggccgaggtggatgaatcacaaggtcaggagtttgagaacagcctggccaacatggtgacaccctgtctctactaaaaatacagaaaattagctgggcatagtggcaggcacctgtaatcccagctgctcgggaggctgaggcaggagaattgcttaaacctgggaggcggaagttgcagtgagctgagatcgcgccactgcactccagcctgggcgacagagcaagacagtgtctaaaaaaaaaaaaaaaaaaaaaaaaccaaaacctttcttcttttaccatagaaaattgtaacaccagcctctctcatcccctttctctaatttctctttatctttgttaactcctttgatgtcagaagcctcatgtggtggcaaaggcttctcacagggtctttgtaatcttgagtttcactcagtggtttgtgtttctttgaactatcattaaaaaaaaatacaacctcacaaataggtatcaacactttaaacagacacttccttaggatgtgggaaaattaattccaaaggaaacacagtgcacgtaattgacacttaacctgccacctctcttgtactattacttcctcttagcaactggcaaggagctggctacatagatgtttttcagcccaccaggaaaaactctcaaatatcattccatgctgataaatcaatatatttaaagctgtggtttttcaagttaaagcagaaaaaaaaaaaaacagaaaaattgaggtgagtatatagatgattgaggcctaattacccgctcatcatttttctgcacagttatggccacccggcaggcagtgcaatgtggtgattaaaaccactggcttggcagggtgtggtggctcacacgtgtaatcccagcacgttgggaggctgagataggaggatcacttgagcccaggagtttgagaccaggctggtcactatagcaagacctcatctctactaaaaaaattaaataaataataaaaaataaaagaaaaattagccgtgcatggtggcacatgcctgtagtccccggaggctgacatggcaggatcacttgagcccaggagtttgaggctgcagcaaactgtgattgcaccactgcattccagcctgggcaacagagtgagaccctgtctcaaaaaaaaaaaaaaaaaaaaaaaaaaacaacaacaacaaagaaaaaaatctattgctctgccaggtttggatctcaggccagccactaactggataagtttttaatctttctcttccaaagtttcttctataaaacgggggttattttgagggttaagtgagtcaatacatgtaaaatgcttagaataatgcaacctccataaatgttagtagtagaagtagtgtacaaggtctatttaattctgagtctttcatttctttttaacactaactacctcttgcccataatctgtgcaaattcatctttttacttactgtacaagatcatgaaaataaacactactgaggtactgaatgtttaaaatatcccattttatctcttattcaatatctaatttattcattcaagaggcatttatacatgtgtatgtgtcaggccctatgctgaacagagggactacaaaggcaaatcagatgcagttcctgataaagagctaatagtctggtgtgtgatagagacaagaatcaggtgagaacagttcaaaatgaaaagtacctagataaaggaatgcctgggatacctctcagagcacctggtaaagacacctaagtcagtctggggttgggatggtaggggaagatgccctggagctgctgggtagatgatccttgaactgccctgaagaacaaatcaaagatagtcaaggaaagggggttattcggggtagaggggaaagaaagagcaatgagcaaagggcaaggcacaagggctagagagagcttggggaatctggtgaacaattagttgacatggctggagcttggcatggggtaggtgggagggagagacaaggtagacaggagccacgtcaccatgggcctaaggagcttgaatttgtttcttaggtgctagggagccattgaagagttccagaaagttgttctgattgcagtatggagaatgaagcagggtaaggctgcagccagggaactagtgagcagatcatagtaattacaaatggcagaagatattaaaataatgatattgtcaggacttagtgatggattgattgagggagattagggaaacagagaagtgtgttggggcctacccaaactgggctgcctccctggcctggttcacaatgcaatcatgtagaaattgcaagacacgtcttcatagtctatcaaatgcaatgccaagtacttccagatattacacaaagcttccagctttctgcccaaaagagagttcttcaatggtctaggcagtcctgggccctccagctgtagcaactctttttggatttgagagctgatacagagtaatgaaacctataatctacagggaaaactttcttaccattcctgcaaaggtaaggaacgttcagtccactttagtacttttcccaggggagagagaagttggtagtttgagcaggatgcagggaagaatgcaagttcttaaaggatgggggaacacttggacaggtaaaggggaaggatatatatagagagggagacaacgaagacagaagagagaggaagcaatggaggaagcaagagggagtgggtcaggggcctaaaagggaggttgactttagaaagagagaaactctaagttgggaaagacacagaaaggttagataaaagtactcagaaaacttaggagaggaggcattgtgaggaaattcatgttgaatggcctttaaaaaaaaaaaaaaaacttagcaaggtttcagagttgggagtggattgtggactccagggaatcgttaaatctttgagatattcactatgaggaatatgataaagggtcagttaaagatcgacatcatgattgcttaatagcatagaaaacccaggtagaatgcaactgaatagcatcctattgtagtgaagttaatcagtgtctaagataatgcatgtagagcattcaggacacttggcactagaaactctcagaaaatgcaccatcaccactgccgcctttctcatctgtcatctcaattaactcttagcagcaaggagttaggagtagagaaagcagacattatggtcttcttcaggctagagactgacttcagtggacatgatgagtgggcaaggaagcaagggaatcgaggttagtagaagagtggccttgggatctttgtgggtagggaagaaagtgacaccagactggcttattgactttgaggctgatctagtcctgggactggctattacaacaaagatgaagagcagattcagtgaggggatgatgagaaaagggattgtagaactgagatcctaggaacttttgatagataattaggaactaaggatagctgagcttgtgggcaacttcggtggaatagaaagaaatgttttttaagtgttgacaggttgaggaactcttagatcagatccatctcagttatggcacatattcaagagtattcaaaaacaaggctaagaatcatggagggcttgttcacatagagcagaagctgtactgtgcttggagggcttgaatttgtaagtcccctgtctcacctctcctgggtctaaccattcaggcttttctgagtgctttttggaaagccaggatgtgattcatccctatttcactctctctatatatatatatgcatacatacacacacacacacacacacacacacacacacacacacacactacagatatagatacaggacagcagaggcacctgtggagaagtgatattgtactatttgagatttgatagataccattacctgatgctgattatagtgtatgtatgacatcattggaatttaagtttttccagtaaattataattgtgccaatgcatgtatttgattcaggtacaatagagcagttattaatccaagtcttactcttttaaaggagtaagccctaaagggctaaagaagccctaaaactatgtgaacaatgggctgaaagtacattgttacttcatctgttggaggtgtttttaaactatttggtcatttcctttatatcagcacctatttccttgatctgcaaaaagacgacttcttccccaaaccagttttgcaaatccctgaattcattagtatcatctggtatgtcatctcactgttaaagttcagagaagtagattgaaaacatgctttgtatcattttacaagggttattgggagaagagtgaaaccactctctggaatgtgagtggaggcagggaaaggactcgattgtctctgccacgaccatgaactcaaccgtgaacctcagtaaaattacaagatccagcatgccgtgcccctgcaggtggcttggtactagctgaaaccacagatgttaaaccctaaatgccaagggtctgttctaagtattacttggtagaagaattaagttgctgggttttttttttttctgctctgtttaatgggttgtcatgtcgcccttgcaatttgcctgaggctgattaaaacaatgacttcagcttttgatttcttttcaacctgcagcaatgacctttaaaaacagatttctcactatttaactgctagttttccccagtaatccttgctcactctctccctcttctaccttcaaatatgtgcatgcatgcacacacacacacacacacacacagagcaccccatattatatacactaatgggttattgggttcttatgtaaataagtaactccagaaagattacttcataaagtgctgaagaagcttaacacacaggaggttaaatatccttttatcttcctaacagaagaaataaatctataccttgctataattagtatctgctatctatctatacctatatctgtctatctacaaatgagtaagttagttaatattaattttatgctggtgttactgattcttgccgcttagagaagttgggtatatcaaatactgtttaatatgattaatgataagatgctgatttattgggattctggccaaaacggtgcttagatgaaaaatgggcagatactataataatttccacccaaacaattctcctattttaaaatttatgcattgtattgtttgaaagacatagccttaagttcagggtcaagatacagctcatgtagttaaaggtatccagctgctatctctgtccatatttgactctcagtagaataatgtcattcctcaaaggtctgctattgtttttctcgtttgaggtccattattatatagttacggtaaaataaaagtccctctttcattggctctgttatcaaagggtatattgaatggaaattaagatttagaagaaatattcaacatcactgaccttggtgtagtaacagtactctattctcagttttgagtaatgttttctttcttgtatggaatccattgaatgtagtgataagggagtgatccctgagttctctctatggccatggaggcttttgtcctagattcttgaggactgacatctttgagcctgcacctttttccttattccctctctctatttttttttttgcctctatccgcaacaaattttacttccttttccatctggaatctggtaacagtgatagtcattctccactttttgcagttccactcttggacggaggagagggttcttatcctgggtgtggaggagcagaggcagaggtgaccttcacaatggtgctgacacagggtgactctctaagaagccagcaggcatttctcagtgcagagattaacttcttaggagtatattgcttgttgttattattattaggctgaattgataagctagaagaatttgtttccttctcatgtttgagttatgatttagagcacctttttctattacttgttcttcatcatagttggggagtgaaaggaagagcgtatcctgtctcacctacgtgaagttcttgcagctctgtttgtacctacctacatggaagcctccacttccataggcataactggcagacagaaagaggctaattgattaatgagtcacttttgggcaaaatatgtttgtcaatatagttcataggactagcagctcaaacaaagaagctagcaggcccagtgatgagatattagagaacaatgacacagaaatggttttaaccataatgcagatacagagattaaactagagtgaaagctgcaacactttaggagtttatttcatgagaataattcttctagtgtttaaaccagtttggtgtcctctaaagctcctttcccactcattggctgggccaaagatttgaacaaagacccccatcctctacctcatctatgcccactgttgtcttaggggaactcccagcctctacctctggctctgtctttcccgttcttcagattctattcttacgctgcactcatttccttggacttgatggtacagacttgccctcattcccaccctacttgatccatggattcaggcaccagtttcccctttacctgatccctgaaacctaaggcccgtcctgctctccacagtctcccgctccactgccacaccaaaagcaaactccaggaaccagtccaagccaagactttccctctaagctccaactcgcaaactctgtttgtctgagaagccagccttggcagccaacatacttacaaactcataaaaacaagtaggaaatctaagaaaagcaatataaactttactggaatttgaaaacgtcttctgagccattaaaactacagtgccttaccacatacttttgatttagtagaatgttttttgctgtttatccattcatttatctatgtctccattcctctgagctttggaatactcgatccaagtagcttttagttggagatctgtaattttcacattaaacgaggaattcttcagcaaaaattgataataggtcctattctcaagtagggcactagatggagcatgtgaatttaaaggaaattaagatctatagttactaatgacacaaatcacttaactcaataaaattaaaaaaataaaccaagtttatttttattaatttcaactaaaaatagagaaatataaaacaacgtaacgctttttataagcttatgcaaagtctaggaaaatgtttttaaaggagataaaaattgaaataaataatgctttttctctacgatagaccctccaaaccccatagccagaggaggaaagttaagcgggcagcagtttccaaagaacactagttgtggaaggcagaaatagtgctacacatatatatattttttctggttgagaaaacgaagtggtctttatcagagtagagaagtcttgcatctacatccacttctagattgcctacttcacttttaggagcaaatatttctaaagaatttgatcacctgtaagcatggaaagaggccacacattgctactaatagcagttaaaatttttaaaaagttattttttgttaatacaatattattggggaagattttttacaagaatcaagctcagatttgcagacaacatctgcatgattcttggaagttatatctgtgagacagattggcatagcacacaatctccttcaggctcagaagataccaatgttgatcctagtgatattgcattgtgtatattcacactgaaaattaaaactttctactagactgcatctatttgtgagattgcaagtaaggtttggtccatgcttccatttttagttggctataaaaatgtcatccaatgtgaagcttggcatttctgtatgcagctcaggctgccattaaatccaggtcaggagttactgaaggaaaaaaaagcctggaaaactcaccattggttcagtggtattttgagttctgacttccttccccagtctgcctgttacaatttacttctcagagtcttaagatagctgctccatgcattctgacaagggtatttagttgtcttcagtgaggagtggagagggcttactccatcttgaccagaaccagatctgaggtaattttttaattattgattttctttgtcaaatgatgtgcagaatatgcaattataagatataaatgtaggaaggagacaaactagctgaatttaatatggtaatttaattatttcatgaaaatgtggtacaatttttttttttttttttttgagacggaatcttgctctgttgccaggttggcatgcagtggcttgatctcggctcactgcaacctctgcctcccgggttcaagcaattctcctgcctcagcctcctgagtagctggggctacaggcgtgcaccaccacgcctagctaatttttgtatttttggtagagacgggatttcaccatgttggccaggatggtcttaatctcttgaccttgtgatccacccgccttggccgcccaaagtgctgggattacaggcgtgaaccactgtacccagccagtattttgttttttgattaacttcaagcaaaattattcttaggttttatgtgaaggggattttgatcggaaatatgtatcctcctgctgttttatttaacaaaatggctagctagaggcaggcagcagctctgagttttagtaaaaatctgtattacaaaccaatttgatttttctttgccatcaccaatatgtaaagtcacagataaataattctgtttaataattttaaactgcttaggttataaatttgatttgattaaataaaaattaagcttcattctactttggacctttatatgaattagcagcaaaactggttctaggactggagatgactaatagcatgcttcaaatatctcttttcaaatttatcagtgatggagattgaaaggtaagatttaacttaataggctagaaagagagaaatccattttatttggccattaatattgcattataaactcaagactcaatatgcagagctgataagtttgcttcttcctttttacctacttttgtgaaatgcataccaaagggtggggtgtacatcaagattccatgacttctagctggtacttaccataaaactttcagtcaacaccagcttctaggatctagctagatagaattgtattggtgggtgatatcctcataagctgtgatgttgatgggcacaaaagtgacagagaagaatcaagaagttatgcttctgggctagtgaatttacagtatgtaggacagtttatgtatgattttgtttagtcaatgatattcagagtaatgtgtgtagttatgcaaattgttgattccaaatgttaacaaggatgtaagaataataattagtacatgttttcaactttattgcatttttatatccatgactatatgtgctttcacagctacctgggagatagacagatcagttatgagtaattctatttatagatgaagaaaaccgatatactggctgttaagggatttgctgagtgtctcataccacattgctcgcaactctgaaactagggtccagagctcttctagccaatgctttcctcctaaaccgcattgaggagtgatgagtttatgaaaggaattacgggaaggcctactttgaccttgaattaattttaaaccttaaagagctatattttagtataccagaggggattattactgattatcaaacaagatttttaaatccttagtgaacagtgccctccaggagaaaaactcacatatatacacaaaaagatgtgtataaagttttaagtgttgcattattactagtagcaaaaaaattggaatcagcctaaatgttgatcaacataggactgagtaggccgggtgcagtggcatatgcctgtaatcccagcactttgagaggccaaggtggcaggatcacttgaagccagaagtttgagattagcctggacaacaaagcaaaactccatctctacaaaaaataattttaaaaaattagccaggcacaatagtgcatacttctagtaccagctagttgagaggctgagtggggagggttgcttgagcccaagagtttgaggctgcagtgagctatgactatgccactgcatttcagcctggtgacagagcaagaccccatctctaaaaattactaaataaataaataaaattttaaaaacaacaaccccccccatcggactgagtaaataaataggtacatattcataaagtataatactacccagtgattaaagtgactgaactaggtaggtaggtaagtgggtaaggtagataggtagatagatagataaatagagtttaaaaatcataatgtttaatgaaaaaagtaagcttacagtataaaacctaagtatgatatcatttttataactaaacatacagaacctgtatattgctcatgggtatctataggcatatgaccaatatttaaaaatagactggaaggaaacccatcaaatagtggtcacctcaggagagaggagtgggatgggacaagggtcacaaagggatttcacatgaataagaaaaaacataaacagtgatcaattatttggtatttactatattaatctctgaaagtgttacgtaggttaaaaactatcacaaaagttgggggtggtgctggtagataaagcaaggggacctcaagggaagtaaggcacttatggctataccccagtgagaactatgtgcctgacactgagcagaagtcagaggtgtttattctggaagtgctgtctttggcatttaagaaaagcaagtatgtgtattaggtgggcccatttggtaacactcctcactctggcaggaagtagacttgaactatggagatcactttatcccaatagttctacagtggcaggaaaagcctggggacctggactggacttcctgtccctgtctctgaagtctctgaacatatcacgtgataagattgtgaatgagccatgcttgctgcccgctttctgctacattatttgctgtcttaatgcttaaactctcttgataaatttctaggcatgagaggatgcataccagaagaccttatcatgtggaagatgctgaaaaatactgccttgaggatgatttggtcaacctagaggttctggatgaggtactaaatatttagtagacaattctcattgaagacatttgtttcatgtgaatggtctgaactttctgttgtagaccatgtcctcctaaggtcatttgaaaatttaattgtttgtgtagctatgggatgaagttcagggagcattcagttgctgtgactatgatcctgtgctgtgtttatttagatagcccctagaatgatgaagagaaaaggatttggatttttgcaataaagctctttatattgtagccttaatgatggattatatcagctgaaaatattttgtttgataaaatttgataaaatatttcaattaacccttaagaagttgtttgttcttcataagaaagagcttcatttagggaaatagtgaagttaatatagcttgaattctaaatttgaagtctgtgataatccccatttaaaatatgcatgtttaatagagctgttaattgcactggacctgtttatgctgagtctaactctggggattgttaccttcaatgtctaaatcactaaagtgtaatacaaagtggttaattctgtatttatgccacctaggttttaagtgcagtgctttgagaaattaacttaccattctgtcggtgctctatcagtaggaacagcctattaaataaaattttaaatacaacattttgactggttgagatgagtttttttttcacaataacaagtaaaatctttgttggatatctcagtgtcttttagcaagtcctaagtgggcctaattctttcagtgtattcctattttttctttcaaggcaaatattggcattgttttaatgaattgggatcattagggtcattgtatgatttaaatggactactttcatcgtttagagaaagatgttcttggaagaataaatttgttgtcatttttagaatctatcccttgactgggaataatatttacctcaataccatttatcctcttcttaggatacaattatccatcagttgcagaaacgttatgcagacttgctaatttacacatatgttggagacatcttaattgccttaaaccccttccagaatctaagcatatactctccacaggtaagggatgttttaagagcatactgctccttaataggaaattaaaactcacaagggcaaatgaagagaaagaaaaagtaagaataaaattatgctaccctagatgtatatactccaaactgcagatagtaatgtaatacaaatggaatttttacatcttgagaatacctttttaaagcaaactatagcaataatagttaacatttattgcgtgcttactgcgtgttagacactgggttatctcactttttcacaccctgtgggacaggtactgttgttaaacctagttggcagacagggagacttagcatagagtgaactccctcttactagctcatgaagccagtaagtatagaagtgaaatttgaactcagtcctgcaggctccagaacctataccctacagtcttcctaatgcaacaagtaccctaataagtgacagattcttggtttcatgggcaataggtagtggagtattagatggtccaggggagagtttcctttaattatttttccttcagttttccagactttatcatggggtgaaacgcgcctccaatcccccccacatatttgcatcagcagatgctgcttaccagtgcatggttactctcagcaaagaccaggtaagaactcaccttcctttcctacggagtcacccagttaagacatgttgtgtcttcctcgtcaactcctaagtcttcctgaaacctttccattccggttgctggtgctgacccaaagagacaggagatgaagtggcagctctgtggaacttgagcataggtaaagccatagcatcgggagaatgtgaaaatgcttttcaagaaacataaaacagtcacatgaggtgcgctcattttctctgataagatataataaaaatgtctctaatatgaatatgatgagaacagtgcaaacgcaacctgattacatggcagtgattgtaataaaaatagcatatagaatggcataagtgaaattctttcctattaaggtcttagaattttcatgattcagtcttttttgtatgaaatattgcacagaggttgacagtgaccatgcaccacaccatttagctgctgaaaaattgtgatagattgggtagagaatgaacaaaccttaaactcaatactaaacacaggctcatccattttacctttctagccttctaattcacattgctcatatatctaatctttcatcccttctttactttcaataggtatatttttctttgtttctttattctgtttgaaatagaagtagtctaatttggcaagcaaattttctgagggtatcaatgtgtggatttcctaagatctggaaaagtcccagctttggggtttgttgagtaatagatgacattataacaacatagattataaaatggaatacatggattcactgtagcttagaaacttagctcttccaaattcttacctttcccagatacttgtaaaatgtccatagatttcatagggaggaagtaaatggagagaaatatatatcgtttttaagttaagaagttgcctcactgtgttgtcttttttgacaccacttctgacaccaaatgttgtattttttccagcatgaaccaattctccaacaccaactgggtgcccaacaattcagttcaattctgacactacctggagttagcacagactccacagattaagcgattagtgccacaagactgttcccactttagatgccagctgcaaatggagtacctaggcttctcacacatctgcccagccgaataccagtccaggggttcttgtgactctctttaggtttgataattcactaggaatgactcaaggaactgaggaaaacactttacttacatttaccagtttattatgaagggtataactcaggaacagccaaatagaagagacacatggggcagggtgtatggggggaggaagggggcatggcacacagagcttccatgccttttctggacacatccccctcccagcacctcaatgtgttcaccaactcagaagctctctgaatctccttgttcaagaatttgtataacttaatctttaaatcccctcttctttctagaagttgggaggtagggctgaaagttcccacactctaatcacatgtttggtctttctaatgaccagtctgaagctgtctagggggctcaccttgaaccaccttcttaggaataaactgaggtatggttgaaaggggctccttgtgaataacgaaagatactcctaccactcttggaaatcccaaaggttttaggagctcagtgccaggaaccagggacaaagacccaatatataatttttattataccacatccactaatttcctttatacctaaagagctcctagaaatgaatgataaaaatatcaacaatacaataaaaaatgggcaaacaatacggacaggtcatgtaaaagaaaagcctcttaagcatatggaaggaggcctcattcataatttttaaaatgcagaataaggctgcactgagataccatttttttaagctattagattgtcaacaatctaacattctgttgttgaggctacaggagagcaggcactttcacatattggtatagtccctaggaaagcaatttggtaacgtgtgtcaaatttacaaatgtatttaccttttgatccaacatccccatttctaggaatttctcctgcagatgaacctgcataaaaatataatgacttaagtataaggttattcattgcaatgttgtttataattacaaggaaaaaactcaaatatcccaatattggacagattaaacagattatggtacatatgtacaatggaacaacaagtagctatacaaaaggttgaagaaggtctctatgtactgaaataggaagatgcctaagatctatctctcagtgaaaaattaaggtgtacagtagtggatgttatatgaagcatgcaagttgcttctgtgctataaattcttcacttgacgctccattttctgtgccagtgcattgtcatcagcggagagagtggctctgggaagacagaaagcgcccacctgattgttcagcatttgactttcttgggaaaggtattgactaatctgctttacgtattgtggcgagaagttcctacagagtaactgcatatttgataaatgatggaagtgctgggttttttttattaaggcttacataaagacattccatctttgctacgtttgcctcctgatagcgaggcctcttaagatgtcagcatgctatccttccttcacgtagggaggagaataattccagcacaaatttactagattatcggcaattaattttcatgttttcaatgtaatagaaacattcagccattaagtagtaaaaatggttaagcactaggaacaggatcagggaaagccactatagtgattaaaaggatgtaaaatagaagcctttgagcaaaagttgagggaaatgaaaattttcagcttggtgaaatcaatattgaaagaatgaattcaaatagtctagtagttacttacactctgaattagtgtactaggtgactaagaaagaatgtatggaatttttatagataaggtttatagactattacgataaatgccagaaaagttacgggatctatttaaaaatctttctaaactggttaggtgttttatctgtcaaggattttaaatgaaatatggctggatttttaaaactgctgtcctaatctagccaaatccgattcatatgcagatctggggagttgctcatatgagaaaatgatgctggtggttgatgctaacgtcccccaaatggggctctttgtaaaaagaccatgtggattttggtgggcaagggatggtgcctggcaactttgctggtgtaatgtttctggagtctcttcttgaccgttctctgtttggcacaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgtaggtgcactactttatcactgtgtttttgccctgcagtaaaaactgggagactttggaaattttaatggttcagttttcattcttgttcttaacattcccctaccctccccaagggcaaagaattatttaagcaaaggatcagtggtagtttttgacctaaaagaaattaatggaaagagtacaaagggctggggtgggcgtgctttagggatgggtatgcttgtttctcctgagttggttgtgtcaggtagaatttagcagcattgcagacattttttaaaaccctgaggccccttaaaattgaacttgttggttaaaaaagaaaaagacaccaagaatatttcacatgttaattttttccttagattgagacagatagagaaaacaattattctgtttttagggaaagcatttggtaatagaaatcaatagcacagactttgatctgggttcaaatgcaggttctgatactcactgtgtgacattgggcatttcactaaccttctctgtgcctcatctgtggaatggaaatgctactagtgctgacctcatgggtttgttgtgaggattaacatgttcatttatataaaattacttaaaagaatgcctagtgtggtacaccctatcagtgttagctactcttcctatgataataatataaccactggtgtggtacatactatcagagtgttagctactcttcctattataataataactcttcatataataataatagctattattataattgttaataataatagctattattattattgtaggacaccagagtttctcaggagcatggctccgcacttccatattaatgcattattgaatccctgctgtttgccagtgctgtgctttgtgttggcttgtaagagcaaactaaataaaaaagattcttgtattcacggggcttagagtatgcggtatatgaggaagcagtaggggaggatcacaggcattaaacaagtaaacttaaatgtagaacaattgtaataagcaccagaaagcaaagtaggtgctattaaggtgaaacgagagaagggaacgacacataacctagtctagggagaaagaggggctccctgtatatgagatcacaggatcaccaggagttaggcaacgaggtggggaccagagcaaggaggaaaagtggcaaagataagactgagaccaaatcatgcagggctttggaaccaggataaggatctcaaacttttttctaagggcaataggaagccactgaacgttttcaagcaggggagtcaccatacccaactttcattttgagatgatcacgctagcttcaatggggaatggattgggggagatgcaaggattgtgttgacatgattaggaggctgttgccagattcatgtgagagagaacgctggcctagactaaggcggtggcagtggagatggagagaagatgaggagtctgagagatactgtgcaagtagaatttacaggaattgttctgggttgaaaacccaagcatcttcctctatcatgtacttgcagtttcctcacgcagtagggactggcatgaacattaaacaaatgaaagacagagtcagagtcatttacgcttccctgtggctttttgattaatttttatgaggtcccctgcttttgtctccccaggttagggtggttttaaaatttagggagctacctctgacagaatggaaagcatagtgttctgtgttcaaatgtaaagtggtcttttacaaagataatgtgaggagagttctaggtcacttaatgtgatatgttgcttattaatgtaaatattcatataccttactttcctcatatgcaacatgggcataataatgtcaacctcacaaggctgttatgagaattaaatgagatgaagagaagatggggcctgtcccagtcctgttcatctaactgttgggattcacccccttctgggcacactgtagggttcctgtgtggctgggtgtggtcatataactggttctggcaagtgggcatgtaatggcaaccctccagagtctggcacagtgtaagatgggggctgctctgccagccacagcccatcagtgactgcagtgagcacagccccaccgctgacctgccatggacatgtactctgagcaagaactaaacctttattgagttaagctactaagatctgggggtgtttattatcataacaaagcctagccaatcttgacagataaagggatgaaaatgaaactgaagtgatgctagggatggatgtcggcaggaaaagcttggaagaattgagaactagatggatctgtagaaaaactaaaggaatgtaagactaagatgggccagccaaagcctgcacatgtaacagaggttaaagaacaagtgacattcatctcaggcctttcggttcctgtctcagtgaagggtgccaccatcactagatgctcaagctagaaatctaggaggcagactctaggtttctttccgtcaccatcctcattcagtctattaggatgttcttttggttgtttctccagaatatatataatatttaagcttaccgttattctccatcaccactaccattaccctatccaagctattatgctttctcacctggaccccctcactggtttccctgtagccatcttggcttcttataatgacactcagagaacatgaatccctttagtcctgtatccctggcacctggtatagtgcctaccgtgactggcaattaatatgtttattcattgaatagtcacatttttctatttatatatatcctataacatgttgtatatcttaaatatacacaataaaatttatttttaaaaaataaaaataagggctgggcacagtggctcacgcctgtaatcccagcactttgggaggccaaggcaggaagatagcttgtttgagaccagcctgtgcaacatagtgagactctgtctctacaaacacaaaaaccttagtgggggatggtgatgtgtgcctatagtcatggctactttggaggctgaggtgcaagaattgcttgaacccagaaatttgaggctgcagtgagctatgacctcaccactgcactccagcctggacaacagagtgagaccctgtctcttaactagatttattagttaagtgaacaagtgagtgagaaatggcaagtagaggcatctagaatacagggcagggataaagaatgtcacagaagggctttgacaggataaacaaccaaaggaagatgaggagacccaggagaggctgaacagaatgggggccatgccacaaaggcggataaggggagaagaaagacgatttcttttcatggagctaggttgaccaaagaaaagatttgccaaaatccaagggtatctacagaagagactgtcctcctccagaggaaagaaggggatgtggagcagtgcttttcaaactctgtgctaagggaccactttttaaaaaaaatctccaacccattttgaactaatacctttgtaaaatgcaatgcaaattaattatcagaaaaattatcatgctcttggatgtcatggcaatgtcacttgctataaaacgtctaggcatgtacttaccagttccttctcttgttagaaactgacagcagtccacaggctatgctcagagtagcacctatctgaaaggaccctggccagggtagcctaaaagaggtggatggcaggagaccagactaatgaatgacattttgagtagtacttttaagaataccagcttgggagagtgaaaaacctcagttctggaccaattctgctccctaacctgctgtgagacttgcaggccacttcctgtctagggctccagtaaagtagaggatttggctgatgtctctaagctggacctcactgtctctgaagcaacatgtggtacaagcagaaggtagtaggcgtttgggctgcaatagaaagagctcaacatatgtaacttgagctgtttcctgtaaatgtcccattctctgaaaccttttgcttgtcgtaaagtgtgtttaataatgcaacattatgacaattactatactaatcctatcactattctgtaagtgggatttataatatttaattgcctgaaaatacaaatttgccatggaataatcttttgtacagaaaggaaatggtgtaaaatacttgggatggggaagccagaatatattattactaaagtctctttttttttcaggagagagaaaaattttcatatattttactatatttatgctggtcttcatcaccaaaagaagctttctgatttcagacttcctgaggaaaaacctcctaggtaagtgtcaggggggttggttgttaatttttgatgaatgtacgattagcagttgacaaacttggaagtaaatggagctgttttcctaactggaaactcacagtctatttaactaaagtgcccagggtgaggtggcaggaagtatccaccattttcattgtctagaaagttcaaaaactcaactgcacatggtttattttttttcagccatttgcatcattattctaccacagtattagactataaaggaaatgggctgggtgtggcggctcatgcctgtaatcccagtgctttggcaagctgaagtgggaggattacttgaagcctggagtttgagaccagccagggcagcatagtgagactctgtctctacaattttttttttaattagctactcgggaggctgaggtgggagaactgcttgaacctgggaggtcgaggctgcagtgagccaagttcgtgccactgcgctccagcctgggtgacagagcaagaccctgtctcaaaaaaaaaaaaaaaaaaaaattagctgggtgtggtggcatacacctgtagtccaagctactcaggaggctgaggcaggaggatcactagagcccaggagttcaaggctgcagtgagctatgatcacaccactgcacttcaggctgggcaacagagtgaggtcccatctttaaacaaacaacaaacaaaaaatggaaatgcctgtactactttccaagtcagtgctcattctgtttggtcatgctccacttcatttaggtacatagctgatgaaactggaagggtgatgcacgacataacttccaaggagtcttacagaagacaattcgaagcaattcagcattgcttcaggattatagggttcacggacaaagtaagtgatgatcaagagaggaactcaagtgacaatattcttatatgaatgtgagtaaagatgtggtatttctcacttgggataagacacttgctttcaaatgccatgttggtcatgttataaggtcttgctactcaaagtgtggtcccaggaccagaaacattgttatcacctgagaacttattagaaatgcagaccctgaggtctatccaagaatgactgcatcagaatataatcattttaacgagaagtccagatgaacatcaaactaggggagcactgttttaaggaccatgtgctgataaattgttatcattgtcatcaattcattacacgtgtaataacaaataccaaaacaatactgtgggttttttttctgattgagcgttcttccaaccattaaagtgaacggggggtaggagtacaggaatatgtagatgacacccaagtcacagaaatatatttatgcaagtagctccttaggtaacaagacaaactaattaaaaccctttcaactttcttgcagttatttccttctccagggtacacagttgcacattattaactatagctctaagtactgtactactttttttttttttttttgagacagaatcttactctgtcacccaggctggagtgcagtggcgggatctcagctcactgcaacttctgtctcctggcttcaagcgattctcctgcttcagcctcccgagtagctggggttacaggtgtgtgccaccacacctgactaatttttgtatttttagtagagacggggtttcaccatgttggccaagctggtcttgaactcctgacctcaagtgatccacctgcctcagcctcccaaagtgctgggattacaggcataagccaccatgcctggccaatactgtactacccttatcatcctagatacaagctgtctgtattaaatatatgctaggggtgacagacaatatttataaccctaggctcaaatattactctgtgatacattatgtcatagtttctgggcttcatgccatcaattttgcaaaatatatagattcttttgcttttccaacaaagggggtgaattattaggaggtaggtgagagtgttaaatcttaagggattagattacaagacactccagttaccctgggatggccactccagataaaggattacttctgtgtaatgcagtatgattggctagcccttccctcccctgcatggttgattttaatcataatagtacctttcttttttttctgtctagccagctgttaattttctctgtcagcctcccgcagactttaaactgacagacaatggaaaatcccaaaggtcagataaaaatataaatatattttccttggcttcttagaggggggcaattaaacaggttctagcattgttaaaggacctttgtggttattaacttaaagaacaggttttttaaatcaaagatgcatccccagaagagttaaagcatggtaggaatggcagtggagcaatttaaagtcacttgtgtcatgccaaagtacgcaggggcacatgtccttaaaagggtacaggaaccatagagaagtcaaggttaataatcattaacagagttaatattttgttttctttgagtacaaatatagttatagaatactgtgaagagactgatcctagctgaacccatttatgcctagtgttccattattggaatgctaaacatgtgggagttatttataccctactgctcaaggtcatcaccaaggtctgattgcaaaaattcaaaacattgcaacctcaggcttaggtgggttaaaagaaagtatataatggtgccattctaataatagcaatgtactgctaataataataaaacagatgctatctgtttcaggataaacaacgttgaaaactgttaaaatctgttttagtacaacaacactaaagcattaaaaacagaagaattaagtatgttaagtatatgtccttgaagtaagccatccctagcccctctgggaaaaaaggtacaatagaaataaatgaatgactgtatgaataaacatgaaaagaaaaaaatgtaaaagatggtgaacatttttcatttgtgcctggtctgtactgttaaatgaataaccagaatgtaatggtgttatgtgtgtatattttcaccatgtcccacattaattcatacaggaaataaaccaatttatataagctgcaaccttagaaatgaaaggaagaagcaggatcttctctctccaactctgaattctgtggttctatctctgctgacaacctgttttgctgagttaactcagttcacttcatgtttataaactcaaaaagtagtgtgactaaattcagaaagatccagttgaaggtagtcaggaaacagatgccaaatgctgatgtaacagaactttctcttaagtttttctggcagacatttctagataaagcttaaatgaactgatcaagtcaatcaaaattatggttcttctcctttcttacaatgtcactagttccctgcaggaatccctttagtttttctcaaacccttacagcaaaattatgagtagcaaactttagtgtggagtcaggagcatgaattttaattctgggacaacagccaaagtatctgaaagaacacttgaccctgagtttattgtaaagaaatttccctggtggaggagtcttccactaataatgatgatgactccttgtggagggctgggggattatacctaagaccttattgtgaagattgtgcttttcaactcttatttctggagccaaaccatactatttttgtttaaaattatatttgtcttcctggtaggaattaacatattacataaattgggttttagatatgtttctatttaatgctacatgaaaactttttgggcagatgatctatgtgatggtcaagattggacgtacactatagatccctgttggagaggttagggagaagcctttgagatcggcgcaaaatttcttccctttcttcaaaatagattatgaattgagagagtactgctctgaagagagattgaaggattatatgtgaaaatatgactcgggagtcttgaggatttctaatgtcttgatgacagacaataggataccattgacttttaagatgacaaaagttgtgagcctctgcaaaggagaccgagaagtgttggaacagagcctgtggggaggtccttcagctggtcctaatgcagtgcttagggaagaactgatgaaaaactgacgagatttacaaaaaagaaagaaaggaaagagagactgggaacggaagtaaattcctagggatataccagagaaacaactaccggagatgcctgtgagccaggccaagggggattttcttagagtagcgccaggctaacagagaaaactaagttttctctctacttttcaattagcctcaactctatcaagagaatactacatcaaaagaagtgtcttatgagaaaagagaagaaaatatcagacatcctgcagtggggctttgatggagaaatgctctttcttccccactgttgttgattggtagtgaaacagtttatacccatcaacaataaattgagaaacccagttggaggacttggtcttcttgagtaaagctattccactttataatatagaaagctgaaaactggtagaaataaaaagagacagcagcgtagcaagattctgcagaaaaggcagagatgccaggaaaggctctgtagctggagatgaagcaagagaaaatggacaaggtaaagaaggtgaaaaaaccttccctggctgtctgttggggagacaataagaaaaatttgattgaaaagttttaaggcaggaagagtaatccctcaggtggacatataactaattgaattttgccatgagtgtaactgatgttttgacctgaaagcagaggctcctagatcagaaagggagaactaattaacccaaggttaggactgatggagtcaagtggatggaatagcccagaaatataaactccttaataaggtgagcattggttaccccgctgttagttctcactaaatcaaggaaggagacccaatcggtcattaatttcagtgattcacacagtgtttgaacctaaaagtttttctcagggtcatagatagtttttcactttaaatggttgtctaggcactatgctgaagagggtagtgccagagaagcaacggggcaagatgctggtttcaagggtatagtctttgacagtcattttctatggtgattatcccagtggtgaaatgctggaagtcttattttgggaggtttcagagcttgtactgtaatacatgaagaaagagagagagagagagtctttgtgtgatgtgtgttttaattacaggaaatacatttattttttctaagagtactgagagtttcagataacctcgatatagaaacagctgatgtagaactcactgcaagagtctctgttttaccccctgggatctgcctctgtgggagttgctcagtgtagtgagcaagcctcacactgtattgatcaaagtaacgaggtgctgtcatgttaaatccgagcaagtcccagaaaacctacttagtaggtgttctccttagccactcttaagttgggtgattaaacaatgattcttaaagtaaaaaaaaatgacatattgcctttgatttagaagttggaagaataacatttatccattgtagaagcctcgtttaaaatcttcatttgtctttgtagcattatcaggtatccagcagatgtcactattatagtctgtgttcctttttttggctttactgagtaatgtttataggaagttgtaatctgtgaggcaatgctttatcaatggtccagtgaccgttcctattcctttgctgctgtgtagagtaccaaatcaagttacctgcctgagtatttttgtgaaagtacttttctctgtctataagcataaaatgcaaaattttcctggctatatatttcgttgtttcacgtatagaaaatgtaagtttttaaataagtaaatacaccttaatttctttttaccattaatgatacatatgtattcaactttcaatataaaaatagagcttagataatcggaaccgtttttactcacatttctgacaccaaatatgtgggtttttctcccccatacctgcaaattatctggcaccagctgggtgtcctacaattcactcaattctgaccctctccacctggagttagcatcagatcccacaagctaagggctcagtcccacaagactactctgactccagatacctatacttctgtctcctatacttctgactgactggctataaattgagagtccccacaattccctcctcaggttggataatttgctagaatagtttctagaactcaggaaaacactttacttaccattactgttttattatataggatacaactctgctgggcgtggtggctcatggctgtaatcccagcactttgggagtccgaggcgggtggatcacctgaggtcaggagttcaagaccagcctgaccaacatggtgaaatgccatctctactaaaaatacaaaaatttagctgggcatggtggcaggtgcctgtaatcctagctactcaggaggctgaggcaggagaatcacttgaacctgggtggcggaggttttagtgatccatgatcacgccattgcactccagcctgggcaacaagagcaaaactctgtctcaaaagaaaaaaaaaaaaaaaaaaaaaaaggatacaactcaagaatagtcaaatggaaaaaatgcatatggcaaagtatgtgggaagtaacatagagcttccattccctctgagcacaccactctcccagcacccatgtgttcaccaacctgaaagctctccgaatctcatcatttaggggtttttacggaggttccattatattcacatgattggttaatcattgaccattagtgattaactcaatgtctaatccctctctgctccccagagattgggttgaggaggacccaaaagttcgaactctctaatcacatgattggttcctctggcaaccagctctccatcctaaagctatctagaggtccaccaagagtcacttgcttagtataaactcaggtatggttgaaaggggcttgttgtaaataacgaaagactcctagcattcctatcactcactttcaagggttttagatgcttttgtgccaggaactgggagcaaagaacaaatataatagtccctccgtatatgtgagggattagttccgggaacccccaattcatataccaaaatccaagcatactcgagtcctgcagtcaggacatgaaaagtcagccctctgtatatgtgggtttcacatcttgtgaatactgtatttttgatccgtgtttggttgaaaaatatctatgtataggaggacatgtgcagttccaacctgtgttgtttaaaagtcagttgttggtcaggagtggtggctcacgcctggaatcccagcactttgggaggctgaggtgggcagatcacctgaggtcaggagtttgagaccagcctcaacatggagaaaccccatctctactaaaaatacaaaattggccgggcgtggtagtgcatgtctgtaatctcagctaatcgggaggctgaggcaggagaattgcttgaacctgggaggcagaggttgcagtgagccgagatcgcgccattgcactccagcctgggcaacaagagcgaaattccgtctcaaaaaaaaaaaaaaaaaaaaaaaagagagagaccagtctggccaacagggcaaaactccgtctctactaaaaaataccaaaaagagctgagtgtggcagtgcatgtctgtaatcccagctacttggaaggctgaggcaggagaattgcttgaacccgggaggcagaggttgcagtgagccgagattgtgccactgtactccagccagggtgacagagcaagactctatctcaaaaaaaaaaaaaaaggttaattatatatatttcttgttatataaaaatataatttaatatacaattatcacagataatttctagtgagtctttcaaaatatttcctgacttcataactatatattccatcatttaactttaaaatgttctaggagccatgaatgaatgtcttcccaactacttcataaaagcgatattcaaaagaggttaaggaaacagctcctctcttgctttgaacaaaagatcatacctgaatttgggagctggtattagttagggtaaaaggctgaaagtggcttaaagaacaaagaagattagttatctcttaataaccatttccagataagaggttcaggttgcagagcaactccgtttatgcaattgttggtctaaggcatcctcatcagtggcatggtaaggctgtgctgggagttccagccggcaataatgagaaggaaagtgtggaggaggcatgctcatgccggtaaggcctgggcccagaagtgacccacgtcattctgcttgcttcattgttaaaatgtagttatatgacgacctctaactgcaaagaagtttgggaaattttgctgtgtgtccaggaaaagagggagaatggactttggtagacaactagtagtttccactacaggtctaatggttcattagtttgactggcaatgaccttcatatatggttcttgatgtccttttcaggaggtgcactcagtgtacagaattttggctgggattttgaatattgggaacattgagttcgcagctatttcctctcaacatcagactgataaaagtgaggtgcccaatgctgaagctttgcaaaatggtaattatttgatatttgtgggctgtgttgttgccaaagcacgtgcttctttaggctctgtaaaatataatgcagcatttgctggtccttttttttttttttttttatcgagatggagtctcactctgtcatccaggctggagtccagtggtgcaatctccgctcactgcaacctctgcctcccaggttcaagcagttctttgcctcagcctccagagtagcttggattacaggcgcctgccaccacgcctggctaatttttgtatttttagtagagacggggtttcaccatcttggccaggctggtcttgaactcctgacctcatgatccaccccccccccctcggcctcccaaagtgttgggattcacccagcctgctggtctttctaatggctctggatgttttcatgaactagtatttccccaaggatgtcctgtggaacaccagtgttccttccataagctgcaagtattctgcagaaaagaattctatggcaggtaattttgagcagtgtttttttcttttttttttcgaggcggagtctcgctctgtctcccagactggagtgcagtggcgctatctcggctcactgcgggcagtggtttttaaccttggctgttttaaaaaaatcatctacaaactgaaaaagatacaggaggttgggcccattctgaatccactaaatcagcatatacaggagagaaagcaggcgcctatttatttttaaagttccacgggtaattatggtggcacaaagagtgagaatcctcaaatatgaacaacaaacaaacaaactgatttaaatgaagtaaaaacctttttgtgttaaaactgtaggacattttagggcctttaatatatgaatgtattttgtgactaagggtagaatacagtctgcacctatttccccaatttatttggcaaaagaccacctcctcttccttttttttcatcaagcatctatgaagtaagagctttcagaacagtttgggagatactgtgtcagtctggaagcttcttggggttagggatctagcctgtttatctttgagtcaaaagtacccaaatggagtctggcacatagtagatgttgaataaatgctgaacagactgactgaatgaaggtctggctacattctgtgttatccttactctttgtttcagctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatggcaagttcctcggagagcagagggtctcaggagagctgtcattgaccccgccgtctcttagagtttgcaaaaggaagcatttggtcctctctgggattttctttctttttctttttttttttttttgtggagtcagagtctcacgctgttgcccaggccggagtgcagtggcacgatctccgctcactgcaacctccaactccagggttcaagtgattcaactgcctccgcctcttgagtagctgggattacaggcgcgtgccaccacgcccggctaatttaggcattctcttttagaagacacagtgagatccaggacagttgaagcatttgtacccgagaggcaaaggactgaaggagccactaagtgtagtatttgagagaatagtcttggctgggagctggacaaactgggttcgcacccaaactctacagcttaacccatttatgcctgaggttgcaattttttgaattttttcatcagaccttggcgatgaccttgagcagtaggatgtgaataactaactcccatatgctttgtgttccaataatggaacaccaagcataaatgggttttaatcagctgcatgttctaagtcagttttctcacctgtaaaatgaggataataatatcctcttcatagttttgtttttagaatcaaagagacattttatgaaaaaatttaaagcacactatcttacattactattcctacttcttcaactacttttccttgctctttcctaggcgtagtggtttcctatattgtggaggaattcaccacatcaaattctgaagagtactcttccagttatccttgtgggtagataggtgggagaataaataagcaacagctgcaaccccttcaaacaaaaggactttaaaaattttattttatacatggagtttctgagtaagattttaaaggattctactgcttgaaaaaaaaaagaagttgaaaatactattgaaaggccaaaagaacaaatagtttgagacataaactgcttcttttcttaggggtggcaggatgctgctttccatgagtgggtgaattgggtacttgagctgataagcacttgggcacatatattctcatcctctttaggtgggtgtttcctcccctaaagagttttgttcttctctctcatgcagtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcaggtaatagtgaactctgaggtaactaaacttgatggggaaaaggtgtctccaagctgcccacaatttgtagcagaaaccctgtagactaacaactaaaagaccctagagagaaaatagggtaaggcagtcctggctaaatagtctaaatttgtctggaaaaggtctcgatttctgtggaaaggtacatttcctcacttgagtggagctggtgacaagtcactcatttaaattttgtgtcaaaactctttcgtgcatattgctcaaaatactgtatctcttctactttatttaactaaaaatatttatgattgcgttcaaaatgacacagatgaccttgaattcgggacataggttcttaactgctacactagccctccctatcccctatctgctatataccagatcccacagtcactggagaggtatctccagggaagagtaagatgtgttcttggttttctagaaatggaaatcatccctctatgagtttaataataaataagacagagtaagaaactagtggacccaagggatggggctcttttcctgtggcagcagcctatatagcagtctgatcaaccccaacctttacttaaaccttaagactctcttctgtatgaagtagttgcaataatgaaacattctggctaagcctcttcgatgcagggataattgttttaatgcaggcatgaggacgcacaaactcaacttcgatgagatagacacaaagacatttagtgaaaataccagcattgcttttatctctggagctggataaatctgtatagcactcctctcccatccactcttgtttcagtccaggttccttccatttatttcccggtaatctggagtttttctagttttccaaccctagatgattcctttgtcgaactccttgcagaagagaagtctgttttcttggtttaaacaatatttctcaccaaaataaattttttttttcagcttcacttccttgtacattagtttctaaatgataagttaccaagtccacatttgagagagatgttttactggtttagctgctgccataggccacttgtaagtcagatttaagtgcacagctttaatggtgttatatgcagaagattcctttattatacacataaaacatatcctgctttccacatgcattcaatgttgctagacccagaaagtccatgtcaaagtatcctggtggtcccaaggctagttttgggctggagagaatcacaatccatttccctccagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttggtaggtaacttctgagaaacaggcatatacatttagaacaaaacttggcttgtgtcatcaattgagtgtactttaatgaatttaccttacatattttgtttatatggtggtttgtaagaatataggccttctttttcattgaattgaagtgttgtggtagaatttgaatgttaaagcaaacccatcgctattcctaacaccttcccactttcctattcttgccaacatgattagcattacccccatgttgatttcatttttacaccttcctctctcttctttcctataggcaatgtttgcttctcctcctttgtgtgcccccatctcatgtcttcccctgtacccccatccacctctaatctgatttcatgcagaagccctttccagtctcctgacttccaggctcctacctgccccatctaccctggacatcccagctagtttagtctttctaaagccaccttctcattaggttactattatctacaggatgaatatagggcacctcgtcctgacatcaaaggccctctattctgtaccctattcttgaatcttcagtgtttttcacaacctttgttcctcacttagattgcgaggtgcttggggcaatgaagcctcagtctttatgtgcctttagtgcttagcagtttctcatacttagtaagctttcaaccacaatagcaaagatcgtgtgttaaaggaggaacaaaaagtttcaagccttttccccagctggaaaattgatttgtggcagagattcacttttatgagttgaaattataaccctcagtggttttcttttatatataacattgtcacaagttgtccagatgagtttaaaccaggttctaaaactaactggcagggcctctggtgtcatcagtgtccatgctaggagttcttagaaacagcaggagaatatacgatcttagagcacagcctgacattaagacaatgctacacaactaagcaaggatataatgataaatgcccatcatatcggtgatctttctccacccttgttaatatcaaggccttattctgaaagcccttattctgagtcattcatggcttgaggaacaagtttttgtttgaaagaggaaataattcacattgtaactctccaacataaaaatccacacagataaatttgaagataatctacgatgcaaatacttctggaggcccaaaggagtggaactgtgctttggcattcagcattatgctggaaaggtgaggccagtgtgacagttattagacctgaatttggcaaagggtaagtgtctgtattaccctgtctgtgctgctcatgaaattgcttacagatttctttcccattttaattcttcctgaatacctaatcataattcttaaagtttctcagtggtgccactcacagaaagttgcccctggcatagaagcaatttctcactggggtggcccacagtgttgccatctgcttctcacctgaggtttggcctagaactgacagctctccagagagaaaacacattacagctttttgcggtgtttagcagtaaatgttcacattctaaagtcatttggagacatgtaggtaatgcaggaaggttaatatcacagtgggactcaatttttagtactttaatcatatgtctaagggccccaaaatgtccagatgaaaagaaaaaaaaattcacattattatccagatgttaagcttttacaacttaactgaaatgtccacttttcatacattatgcctcagtctcaatttcaagttcctgaagcagattagtgactgattcaggaaattccctatcccataaccacaagttccttgcttatgttactcccaaaggagccatttgaattatggctgattggttcctctgggctctgctgaggctgtaggtccagaaaattggtaggagttcaataaaagacatttttgattattttattaatttcagatgtattgaaattgtcattcatattcacatcatggcattggaactgattttcctaactggatgttgggaaattctagtacaagggaaggggattatttttctctccacatagtactttatggtatctattttggatctttgttagacattgcaattcagtttttgcccttaaatattttatttaccttagcatattaaggtcctcctcagagtctgaaataccagcatctaccctgattcccctccccattcctcttttctgcctcccattcctgtcctcctcttctcacctctctgtccttttataactatgtcctacccacccgtcttcttgactcttactattttcctttcttgattttaggggaaaaactttttttatttttattttttctggcctctgtgtcctttgctgcatccatttgccattcaaagcttatttgtagagaaggaattctctgagggtgttccttaaaatttatctgaactggatcccctctgttctgagaaccaagaactactcagcatccttgagtgatcactcagatctcatgaggacctagggaggcagtgagagtacttaaagtggttgtgagcatagagtcaaactgcctgagttttgatacctacctaccacttgtgaaatgtgtgaccgtgggcacattactcagcctcttcctaagtctctgcctgcctaccagtaaaatggagataataatagtgtttacctcataggatggatgctttgcacatggtatctaatatattttaataattattctgatgtgatttatctttgatagtagtcttcaaaaagcaactagacaggccaggtgcggtggctaacacctgtaatcccagcactttgggaggccgaggcgggtggatcacgaggtcaggagatcaagaccatcctggctaacacagtgaaaccccatctctgctaaaaatacaaaaaattatctgggcgtggtgacatgtacctgtggtcccagctactcgggaggctgaggcaggagaatcacttgaacccgggaggcggaggttgcagtgagccaagatcatgccactgcactccggcctgggtgacagagtaagactccatctcaagaaagaaaaaaacaaaacaacaacaaaagaaaacccataaaaaacaaaaaccaaagcaactagacaataagttaagataaactggtctgtcaacatcataattattccctttatctggtgctctggatatgaaagctatgtaaagatgagttctatatagaggttgattaacaactggttaggcaagttgccagtgtcaccaatgacggacagttgacttggctaatttgccgtttgctattcatgttacaggtattatatgatgcttctggggttcttgagaaaaatagagacactctccctgccgatgtggttgtggtcctgagaacgtcagaaaacaagcttcttcagcagctcttctcaatccctctgaccaaaacaggtacttgggaaccctctgatagccctgctcttaaagcttttgcaagaccaggtgaaattttccagttagtgtctgaatactgccagggctgcaccgctaacattgaacttctttaagcaggagtaagggtctaaattcaagaaaaggaaaatgtttgtttcttttgtaattgaattgtgcagcatccgtgtgtacacagacacgtgtagctgcacacataaacatacatacactatccataacatcaactcttagactttcttgtccttcttttcattcttccctttataaagccatacgatatcattaattcatgctaagcaatctaggatagtctcagtttaccaaaacttatcaggaagattatttctacttgtgtgtcattccaagttaaaggagtgtgttgaatcagagttcaggggatcctcaaagatcaccttggtccaatttctacccagttatgaccccaccctacctctctcctaaccaatttggaacaggtccatcacctatgtatgtggcctttgcctacttacagttaccttctgtttaattgctgtcagtcctcatgccaaaaaagcaggaaactagggccaaagaacagaacttccaggtcttaactgtttttccaaatggattctaattgagtcaaccttttagaatgtacctgggattctgctgcttttagctgggcggccaactcagccttctcacagctctactctcaagggctttgtgttttttaggctaggtctggaaatagcagtgggcatgcttttaagaaaaagaggaagagaaacctttttatcactgttcattgttcactatttcctcttcttttcttcccacatccctcttaactggctgccaggtctgatttttagcagcttgcagaggaatgaaaagcctggctaagaaaaaaaaaaaagccacagtctacagcctttgcttcatcttaacttggaaggaaagttgaaatccggctcttttttcagacatgctcctgtaaacagaactagtagcagtgcccatcagaaggctgccctccagcttccattccagaccttccttggagcagccggggtttaattcaatatggaatcccaggagctcggggcaggtgtggaaagggctatctggtgtttccttaccagagacccagggatgtagactcctcatcaggcgacttcagcacagaggtgaagagacagccattattgataggggacatgctctctgggaaaaaaatctatccaaataactcttcagctggcatttacatcctcccacaaatattaataacgacttgtcaaatctgttcacaacttcggaatttccgatttttcaacctttggcaaaataaaaaccatttaacagcctggaccactagggggcgctatgcagaaagtaaggccctgcagccggtctctgttctcccttgattcacccaactgcgggaggaacaggaacaaagagataacctccgccgctgcgtcttttttacccctcccaaagagctttcctcttgtttctgaatcttgttttgaaactacactccacaccacttgatagaaacaaaagtgaaaaataagactagacacaaacgtgatgtaccaataggcttcccagtattcctgagctatatattatgcatagtaatttcctttgagatcctaagcttgagtatagcttaggattctccacattttgagtatagttaagaagccacaaacatcaaaacttataagcatgattgtgttttctttttctggaattatttatgtaggaatgaattcaatcaacaaacatttaaagaacagcttctagtaataaggtactttttaggcaacgagggaaatataggagtaaaggtaatacggctttgccgtacaccaactagaactttcttttaacttcattttctatatggaattttctatacagaattgggcactaatttatctccttatgacaatagttgccctcaaacctcgattctaacatgattgtgcatcctgtgttgaatgtcagaatattacttttctaaattttaaaacgttcatagtctatatttttgggggttattatgttacagcctttgaagatgggaaacctcactggacagaaataagttatgctgttctttgccaatgcttgtttcaggcatgtccctctcgtgaaggggaaggtgcctatacatcttgatgttcccactagaagcaagatcccacactatcctggcactttggaaaagaatatgctaatattttcaatgcataagaaaccattttcttgtcacttttatttttccttgctttaattgttttatcgaaattaaatggagcactagttcagtaagcatatatattatggtcaattactttacaaacctcttttgaggaatgaactacagggaggaaggaaaaagatcaaagttgaggccaggcgcggtggctcacgcctgtaatcccagcactttgggaggccgaggcaggcggatcacaaggtgggtggatcacgaggtcaggagttcgagaccagcctggccaacatagtgaaaccccgtctctactaaaaatacaaaaaattagccgggtgtggtggcgggcacctgtaatcccagctactagggagtctggagcaggagaattgcttgaacccaggaggtggaggttgcggtgagccaagaccatgccattgcactccagcctgggaacagtgcaagactccgtctcaacaaaaaaaaagaaaaaaaaaaaaaaaaaaacttgggaaaccttagaggcaattagctcaaagcataaaaggaggtccagtgctggactcctcaattttgaaagaggagaagacgtttgttaggaagacccctaagagatgttggcagtggtctggctcctgatcttggtggtggttacatgtatgcttgcattatatttattatgctgtacatttatgttttgcatacttttttgtgtgtgcattctgtgtcatagtaatgttgggtttttttctccaaaagatagagaagaccccttaaaatacaaagagaaaaaaaaagcttgatgtggtagcgcatggctagagtcccagctactcaggaggctgaggcaggagaatcacttgagcccaggagttcaaggccggtctgggcaacacagtgacaccccccatctctgaaaaaaaattagaattaaaattgtttaaatgcaaagaaaaactttaatttctttatcgaaggattcctgacagttaacttgaggttttctggtagctagattgccactgtcctttgctttcaaaacagccccaggatcactttcctgttctttcaagttacctcctctctgggttgctgggcaggtaacattcccttcattagtatatatcaaaaaaagtatagtcatgcatagcttaatgatggggatgcattctgagaaatgcatcgttagttgatttcatcgttgtacaaacatcatagagttcttacacaaacctaaatgatataatctactatacatctaggctatatgttgtagtctactgttctcgggctgtaaacctgtacagtatgttactatactgaatgttgtagttaattgtaagacaatgccaagtatttgtgtatctaaacatatctaaacatagaaaaggtacagtacaactatggtatgataatgttacaggaccaccagtttatatgcagtccattgttgaccaaaatgtacatggcgcatgacactactggggcttgatttaatttcttatcaaggttgagaggatcaacctcggtgtgtatatgtgcaatcataatataaaatcatagagagtaatccagttggtattttcttgtttccagctcccactttccagactattgaagagattaaaaagcatgaggagtagaataaggaggcccaaggtcaccaggagacagggctcctcccaggtttctgcagcccccttctgcttacacctggctgcatctggctgtggagctgcctgtgcctgagaggcacactctcactgcaaggttctcagtgaccttgtggtaaaaggaggcagccacagtcaatatgaattctctctgttctcttctcatgcttatgcagccagccttttgcctgcagatgggccacttcagacatgatgaaatgttctttgtaatacttcctattgataggaaatcctctgaagattttaggtgtgaaaatttgaagtagcagcaacactgctttctaacccttcggctgagacttttcaaactgaatgatctagatagaaaaacattaaaaggaaggatgttataacatggtttcaaggcatattttcctgtttgggtaatgttccacttgcaactagtaaactgagagaaaagcttaaaaggctcaggggaagaaagaaacagagtttcaaaaagaacttgaaaattcatttttgtctttgaatcatgaattctgacttccaaatagtagtttggggtgttaaagaagttatgaacttgggagaaactaggaaaaataagaatagcaccagagggaacattctctgaacctcaaagtttgatttttgcttcagaacctagaactgagttttaccctcattgccttcttctgtctgaagactcaggtctcttccatgggatttgatttgcagtgaaaatcaacaataaagtatctgtttattgacttctatttgctcctctttttttggatgggggagacaagatgagcccctacattgtcatatctgtaaagcactataacaccttcactgctgaaatccttgcagtcagttttccgagtcctgattctgtaatgcccaaaatgaattaagctcttaagagagcgccttttggtatccatctctcagtttccattttccacttatggctgttggtctatcctgatagtttagcaaaagggtctagcagatgagctgaatctaattgacaaaatttcagggccacagacatggatagtgctggctcttcctgaaatggaggctctgatgagccagccccatcagggaggcctggggagtgagttcctccttacaaagagacccacttctttctatttaatttgggaagtgtatctcagtcaatagataattatgtattgagaatctgtctagatatggtgctatgtataggttatttctagaagtaacacaacaaagtcccagctagaatggccagagatcaatagtgccaaatcccaaaatgtataaaagatgaacaaaaaatctacattctgaacaggcatgcaaatccataagtgaagcaatataacaactatatccatacaaataaaaatagaaggaaatgtcagggaaatgtcatgggtaaacatgaggaaagacttcttttaactaagaaaggcttattggagtggtgtctgtttgtttgtttttagtagagactagagaaaattggacagtctgggagtaatgaggcattctaagccagggcctacagcactggaaaggagaagggagtggaagttagatgattaaatgaataggacaaggaggaaagacctctttgggcagagggaggttgtgaggaggaagaaatgatggcaggctgctgagcagaggatggctcgtgatgctgatctgaactgccgtgagtggtggggctgtgctcttgaagagcacagctttagggtgagaaaggaaaacttgaacaagggtgttagagactgactagtgagagccagggtgcacccacggtgttgtgtgtatatctgtgtatgaataggtgctcagttaatactttcacattctagatttagatttaggatccagtttgagtaaatttctgtataaaatgtaaggttaagatgttttggtttttttcttcataactatgcctagttgttccaaaaccatttgttgaaataactatccttaggccgggtgcggtggctcatgcctgtaatcccagcactttgggaggccgaggcgggtggatcacgaggtcaggagatcaagaccatcctagctaacatagtgaaaccctgactctactaaaaatacaaaaaaattagccaggtgtggtggtgggcgcctgtagtcccagctacttgggaggctgaggcaggagaatcgcatgaacctgggaggcggaggttgcagtgagccgagatcacgccactacactcaagcctgggtgacagagcgagactccatctcaaaaaaataaataaataaaataactatcctttctccattgaattgcttttgcaccattgtcaaaaatcaattggttattatttatgtggttctgtttcattgatcaaactatctccctcttcaccaataccacactattgcagattcatagtaagtctttttcttgagatggagtttcactcttgtcacccaggctggagtgcaatggcgcgatctcagctcactgaaacatccatctcccaggttcaagcaattctcctgcctcagcctcttgagtagctggaattacaggcccccactaccacgcctggctaattttttgcatttttagtagagatgggatttcactgtgttggccaggctggtctcgaactcctgacctcatgatccacccacctcagcctcccaaagtgtggggattataggcatgagccacaacgcctggctgtaggaaatcttaaaatcaggtagtatgattccttcaactttattcttctttttcaaaatggttttggctgttctagctcctttgtctttccatataaattttaaatgcagcttgtctatatctataaaaagtcctgctgggattttgactagaatggcattaaatctacagatgaatttaggaagaattagcaaccttgctatgttgaatattccattccatgaacatgatatgtctatttatttggatcttctttgatttatttaatcaatattttgttgttttcagcatgcagatcctgtacatgttttattagatgtataatgaagtatttcagtttatagaactagtataaatgggttttttattttgattttagttattcattgctaatatgtagaaatacagatgacttttgtgtactgactttgtcactcacaaccttgctaaacttactagtcctagaagtcttcttgtttttgtttttgtagattccttgggattttctgtatagataatcatgttgtctgtgaatgagaactcttttgtttcttcctttccaatcttaatgctttttatttctttttcttgccttattatactggctaggacttccagtatgatattggataaaagtggtgagaggagacatattgctttgttcccgatcctgaggtgaaaaccttctgtctttaaacattaagtatgatgttagctgtgggttttatgtaggtgcctttgcacttactgttccctatatctggaacttttttttctttcctaagacatacccatggctaacttctcttcattcagatcttttctctaaacctaccttttctggctatcctatctaaaatttcaacctattcaacattttatatccacattcctgttttatttttcttcttagcacttactatcaccttacatactacatacattttacttatgtatcatgtttattgtctgtctttcttcactataatgtaagctccaagaaggtagggaatttttatctcatttgtccattactgtgtcctcaaagccttaaaatatatctggcatatagtaagcattcaatatattgttgctcaataaatgaatagatagatgagccaaatcgacgcatccacccgcattgttcctgtttgctctatcttccttctatatatttttttcacaaagataccacatgaccaatgtatctgtcttccttctggtctaagggcttctgaaccatccctgctcttcttacaggtaagatgctctctacttgtacgcagcatcccttcctctcttacctccacaaagattttgatcctgtaggtatttctcatgtcttctgcatatctgtttattcctcttgatgtggttgttcttatcaacatagtctctttcatcttttcaattatttcttatgggttgaattgtgttccctccaaaaaaagatacattgaaatcctaagccccagtacctcagaatgtgaccttatttggaattagggtatttgcagagatagtccacttaaaatcatgtccttagggtgagcccctaatccaatataaatgatgttcttataaaaaggggaaatctgaacacagagacacgcaccaggagaacaccctgtgaagatgaaagcagagttcatggtgatgcatctgcagcatcgctcacctgaacctgctaactcaactctgcttctccacctgcctcatacagcccaacagccatcttaaaagatacaaactagaccggatgcagtggcttacacctgtaatcccagcactttgggaggccgaggcaggtggatcacttgaggtcaggagttcaagaccagcctggccaacatggtgaaaccccgtctctactaaaaatacaaaaaattagccaggcgtggtggtgcacgcctgcaatcccagctacttgggaggctgaggtaggagaatcacttgaacctcagagtggaggttgcagtgagctaagattgtgccgttgcactccagcctgggcaacagagcgagactccgtctcaaaaaaaaaaaaaaaaaaaaagataccaactagatcatgtcattcctctgtttaaagtttccactggatcctcatcacacctagaataaaatccaaactccttttttttttttttttttgtacacacaaaatcctatgtgatctgtccctgcctgtatctctgtcctcacttccttgaagtctttcatttactctgtttttgttttgttccttaggtattccaagccttttcctgactctgctccagctgctcactctgcctggaacactctttccccagatctttttttctgttgtttttttttttttttttttttttgagacggagtctcgctctgttgcccgggctggagagtgcagtgccgcgatctcggctcactgcaacctctgcctcccgggttcaagcaattctcctgcctcagcctcccgagtagctgggtctgcagacatgggccaccacacccgactaattttttttgtatttttagtagagacggggtttcactgcgttagccagcatctcaatctcctgacctcgtgatctgcctgcctcggcctcccaaagtgttgggattataggcttttccagatctttatgggtccatctctttcttctgacccagaatttaagctcaaatgtcacctccaaagagaggtcttctctgtctacccaatggaaagtagcccctctcttccccactcattctatcacatcatctgtttaactgtctccttcaagagccaacatacatctatctctatccctgcccccactccatgctagcctgtaaacaacttgaagatagagcccttattggtcctgtttgctactgtatatccttgacccagagcagtgcccagtgcatagaaagtattcaataaatatttgttaaataactcagttaactactgcaagatagaaactaaagttgaaggccaagtctggactcccaatctaaggctctgtattagtataatagggctaccatgtcagaacaccacaaacaacagaaatgtattgtccttgttctggaggctacaagttcaagattcaggtgaagtcagggttggttccttctggaggctctgagggagcgtttgttccaggcctctctcctggctcccagtggttttctggcaatcgttggtgttccttgtttctgcaccaaccctctgtctgccttcaccttcacaaggtgttctccctccatgtctgtgtttaagtttcccctttttataaggacatcatcaaaatggattaaggatccaccctactccagtatgacctcatctaaacttattaaatctacgaaggccctatatccaaataaggtcacattctgaggtacttaagggctaggactccaacatatgaattttttagggacacaattacacaattcaatgtataataggatctttctgagtgggagggaatgggggattgggagagcttaaggtactgaggcatcaccaaggaggagggagtggggctgccaagccctaggcctgggtaaggatgggaccagattcctgagtttaaatcacccagtccagtgggtgtgcaggaggcttcagtgaggtcacgtcctagtttgaccttcatgtcattgccagcatattgtccctagtgagttgagattgctctcatttgggccaaaagagctagggagccctggtttccatggctgaggggcctgtgtgtctggcttgcagggcagaggcgggcccatgctctccatactccccttgccttcctgtgttatttctgagtctgacaataaagcattgttggtttgtcttctacataactaagctgagttaaaatgcatctttttattagcagaggcattattgtattaatatcatcgctactaaattttctctttgcaaaactagaattttaagctggaatctggagaagtgtgatttccctggaaaagagtttgtagacctctttgtttgtgaaaagtgcatccctaggtcttcataaaagctctagcacctaactgaaaaatacaggagctcttaataacagccaatgtttacaacagggtggagtgtggtgctcggtccagacctgttttcctggaaataaggcccatgatgagaacagaagtccctgcacctcacattctaagttcaggaaaggtctaagagttgttacctccatcccctggccctgggccacctgggggcaaagggagagtatgcttttcctcccccaaactgggggaaggaggcagttctcaaaagaatcactcatgaaatttggaggcaattactttaaaaaaaaaaaaaagatgcttacaatctcatcccctaattggatacttgcttagctagcaaaatatataacctttccctttgtaggggaaaaggtaactagagagcaagagatgtcatagtggggaactgtcccattttgagttttcagttcttcacaaaaatggagggatcctttgtgagcctacagccccaccattgtctgaggacatagaagaaatcaagtgctactgtctcactgggaatcagcacaaggcaaaaagatgcacacattagatgaatgtactgtgagagttgagctcaaggtcagttaaaagatgtagccagtctggcaagggatcatatattagtttgatatggtgctggagcaaatccccagctagtgctagaacctgtcagcctccgaggatcaggacgtacttttcacaaataaagaggtctaggaaactctttattttatctagggctgccagaacaaattaacacagactgagcggtttaaacaataggcatttgcttctcacagttctggaggatagaagttggagatcaagttgtcagcaggtttggtttcttgtgaggcctctctccatggcttactaataaggacaccagtcataatggattaggacccactcttacagccacatcttaatttactgtcacctctttaaaaaccctatctccaaatacagtcacattctgaagtagtgggggttattagggctccaacatgggaattatggagaagaaacaactcagctggtaacagatcactaagagcttgggtagctgttaagtgtgagctccttaattgtggggcatgtggggactaccacctttctttataaagcccaaggactactgtggccacctagagcggctctgcagcatccccagtcagagaaggagagctctgcccctctcatccccactccctccgccacacctagggagctagcctagagaaggtgagcggagagaagaaccctccaagcccgtgaaagccatacatccagcctgggggcagaaggaaagtggggaaaaagctgcgaattgatgtaacattaaaggttaaaaacaaacaagaatgaagccgggtgtggtggctcacgcctgtcatcccagcactttgggaggccgagacaggtggatcacgaggtcaggagttcaagaccatcctggccaacatggtgaaaccccatctctactaaaaatacaaaaattaactgggtgtggtgatgcatgcctgtagtcccagctactcgcgaggctgaggtaggagaattgtttgaacaggacccgggatgcggaggtggcagtgagccaagatcgcaccactgcattccagcctgggctacaagagggagacagtctcaaaaaacaaacaaacaaacaaacaaaacaaaaaacagaaacaaacaaaacaagaatgaattatcaaaaccataataatatttaataactgaaaaatctatgaaatgggactatgctacggttaaggagctgccatcttcatagaaagctgagtccacatgggtgagggaagttagagggaaaagtgaaattgtttctggattacccacagagaactgagatgtctcagtatgctgatttcatgcctaaggcacaagcagagaaccacagagcttttgcagacctgatcctggtaggctggcaggttctgtcactagctggggatttcttccagcaccagcctggagtgggtgacagattcttgtctcagggaaagggcaatgatacagagagtcccttatgaataatggaactagcaaatgttaattacatgggctcctcatcttcatcagtctgcagctggagctgtgcaattcagcacattggtctagccagctgcacagtcctgtctcatgtgaccatcttgtctgactgaaaagatcataagtgccatgagaccagaaactgggtctcctgtttcatttatataccaaacatgtagtcagtactggtcacattacttcacagccccatgctaattctgctttttagaattacttctgctccccaccgacacccctcatcaccacacctcccaaccctgcccttcctctgcctccccaacatttttgtgttcaaaactcagtcctagcatcacctcttccagggagtttctagtctgggttgggtaaaattcctggtaccactagaatgtaaattccattaggacagggatttttgtccatttggttggcacctctttccatcgtctagagaggagtgtgacaggaggtgctcagagagtctttctgtccagatagagagtgcgatttgtggacggtttcctggtagtgctgggaacactttgaaagcacatcataaatgtgggtcatcctgtgatttatggtgctggcaggaagcccaccagaatcagatctattttaataagttgtgaaattcagaaggcgctccattcagaacttcatattctgaatgtagagagatgagtatgaagcccttattaggactcttgcaccagaggagtgcagatgtaattgcagttacttctggcatctgaaatcaattgctggcccccttcttggattgggcggagtggggctttcccagaagcaaacagtacacttgtggctaaagtacagatctttaagcacgagaaccacgtactcccttcacattacaacttccctcttggaacgtggctgccccggggtgccacccagccctctccagccaccctgactggaccgcatgtgagggtgagtcccaccttactgccacagcctgctgggaggaccagaagctttatctgtgagatgttgtgagggccgtgccctcttctgcccttgtcttggcctcatctggacagccccaggaggaacttcacaccttcctggctcttcccctgttaatggttttcagcccttgtttagaagaatctgattttctttgtaaagcttattgaggggaaaatacgtgtatgatgtggctgtggggtgaaaagagcatcccttgaaactcttgttgcctttttcccccatccctgaatgtttttaggttttaatttgtactctgcaagtgctgtcttgttttttgtttaagtataggtggcttaagtgtttctttcatttttaaaattctccatgcagtttctcctaccctctcagctatggtggaatgaagaactctgaactgtaagtcaggagataagctaagagctacctgaactggtactttgcatctggcagatttgatttaaagttctgagcagcttccacatctgcaaattgaggggtgtgcattaagaagagcctccagattagatgggaccttaaaattgaacagaccaacccctaatatctctagaccagatgttcagtcttgagttgctttgttgttgttgttgttgttgtttaaggaaatggggtctcactctgttgccaaggctggagtacagtggtatcatcatagctcactgcagcctggaactcctgggctcaagcagtccccctgcctcagccccccaagtagttgagatcacaggcatgagccactgcacctgcctgatttactctggtttggaagtgtttacttggctctctttagaaaaccttatgggacagtgctatacaatgaaatgtaaaatgttctattagccacttttttttttttttgagatggagtctctctctgttgcccaggctggagtgcagtggctcgatctcggctcactgcagcctctgcctcacaggttcaagcgattctcctgcctctgcctcccaagtggccaggattacaggcttgcaccaccttgcccagctgatttttgtattattagtagaggtggggtttcaccatgttggccaggctggtctcaaactgacctcaggtgatccacccgccttggccccccaaagtgctgggattacaggtatgagccaccatacccagcagccacatttttttaattagccacattttaaaagtaataaataacaagtcattgaaattaatttcaataatagatcttcatatatcaaaagtattattcaacatgtaaccaatataaaagttattgaaatagtttactttttttgtactaagtcttcaaaatctgatgtgcattttatatctatggcacatttctatttagaccaaccatatttctttctttctttttttttttttttttttttgagacagagtttcactcctgttgccaaggctggaatgcaatggcatgatctcagctcactgcaacctccgccccccaggttcaagtgattctcctgcctcagcctcccaagtagctgagattacaggtgcccaccaccacacccagctaattttttgtatttttagtagagatggggtttcaccatgttggccagtctggtcttgaactccagacctcaggtgatccacccaccttggcctcctaaagtgctgggattacaggtgtgagccaccgtgcccagcctaatccagccacatttcatatgtgcagtagccaccatatcgagtagcatgactgcagaggatcgctgcatcggccacagaagtgcctcattcctgctctcaaagagaaatgcagaaatgccaaggagcccttcttgttgatcctcccaaagaaaataaagtgaggtggggtagcacagaataattctgcagattggcttcttcataaaatatttattttcttgtgtacagacttgacttcagattatctcccagtgtgtaagagacattattgttcccggatttgcagagtttcagcaaaagctttttttttttttttttgagacagaattcactctcaccaggccagagtgcagtggtgcgatctcagctcactgcaacctccgcctcctgggttcaagtgattctcctgcctcagcctcctgagtagctgggactacaggcgtgcaccaccacacccagctaatttttgtatttttagtaaagacggggtttcaccatgttggcgaggatggtcttggtctctttacttcgtgatccgcctgccttggcctcccaaattactgggatcataggcatgagccaccgtgcccagcccatagcaaaagctttttagcagtttcctttgttctttttggagagatagaagtgttccatattatcagtactgagcaatgttttccaaagtgtttttcttgaaacaccaaatttgtgtggtgttaagaggtgtgagctgaataagatttccatgaccaaaaagcgtggggaaggaacattgtttatgaatatccaataggtatctttactgcagaaataccaagagatggctcccgtgtaccagacatccaaaatcagtgagatcctttttgtgagaagcaccttgagggtcaagaatcatgtgggacctgctaaggtaatgctgatcagatgatcttcctgagttccttttccaggacatccttccagtgtggatcttaaatccatttccaaaagttcctcttgccttcctggctctaaggccctgttgctactgtgtctttgaaaaagaaaaactaggccaggcacggtggctcacgcctataatcccagcactttgggaggccgaggtgcatggatcacaaggtcaagagtttgagaccagcttggccaacatggtgaaaccccgtctctaccaagaatataaaaattagctgggcatgttggtgcgtgcctgtggtcctggctactcgggaggctgaggcaggagaatcgcttgaaccagggaggtggaggttgcagtgaaccaagattgcactccagcctgggcaaaagaggaagactccgcctcaaaaaaaaagagaaaaagaaaaactaaaacaaactttaataatgagttatgataatgactctaaccttgggaaaattagtgtctattgtgaatcagattcaccatcttcccctaacacattttaatagttctcttataggtcctgaataagacagtgaatgtatattttaagtggaagttcaatttagagccatttggttttatttctttaatgatcctgctaagtatagaaaacatagcagctttgatttttcgaatggtcagaatacaagaaaaagaaattctgcttctctctgccagcatccttctcattcatagaaaagaaaaatgttcccatttgagatgaaagattctttactttttccatatttatttcatatttcaatagctcatattggagaaaaggtctcaaagccatttatactttattaagtcatcccactctaaaatctttttataatgaggctttcaggtcatttccctcccttagtaacagatacctcctggcactttaaatgaaatacattagaaacaaagccattctaattatcatctctctacttaaagatggaataaaacttaacatttttccccaggaatttaggtcatgttaatagaaactgtatttttctttttagaacacaagactgccttctaacagtctggtccatatgttagaagcatataaagttaatcattttgctttggtgccaacgtgttgtgtgcaaagagaagctgtaaaccacagctgtgtggagtaacaattgtgaactttactggcttgcacatgtgagtcatcagtaaactaaattaaatgttgcttaactgaacttgagagctggaggttgtaagggaagactgctaagattttattaaagtttgaatttagtagagtggttccatctttgcatttcgcaagggacttcaagttatacaaaaatcaaatcaactgttgtccagatgattaggttttttggcttctccataacaatagtgattgccaggtaatcaatgggaatcactgttcagttgacctagtttggtgtgtaaacagccaaaaaaaatccagacatcctctaaaatcaactgggcccaattagtttggccaggcagcaatcccatcagctactcagtagtcttccttgcataagatcaaaatccctgaaatgattacagtgtaattggagcatcttgataggttctctgagcgttactacttagtgctatgaccttgagcaagagtcttgaatactcggcctcagttttatgtctttgtggactggtgacatggctcacagggttgttgtattaagtaattcattttaaaacatttagcatggtatgtacaacattgtaaaccctcaaaaaatgttagtatttaagtattgttaaatattttttgatctggagcagagtgataaatatgagacaaaagtaagtagatttccacatttattttcttaatctctgatttttttttttttacaataaagcagtagataacatttgtttattctctttttccttttgctctgtcttttgttgagagtttgagatttctgtgtttaccttaagaagataaacagggggtgctggggctcatgcctgtaatcacagctactcaggaggctgaggcgagaggattgcttgagcccaggagttcgagactgcagtgagccacgattgtgccactgcactctagcctgggtgacagagcaagacctcatcgctttttttttttttttgagatggagtctctctctgtcacccaggctcgagtgcagtggcgcgatctcagctcactgcaagctctgcctcctgggttcacgccattctactacctcagcctcctgagtagctgggactacaggcacccaccaccatgcccggatgatttttttgtatttttagtagaggcggggtttcaccatgttagccaggatgtaaatataatctgtctctaggtggcaagggtagaaacattctaaaatgttcttctagttcattgtaactttttcttttctttattgtctatgtgaaggataagcaaagggcacttggcaagtcttacgcagtagctgaagaaatattttttgaattaatgaatgggagtagaaatagatacttagggccaggcgtggcagctcacacctgtaatcccagcactttgggaagccaaggcaggcggatcatgaggtcaggagttcgagaccagcctggccaatatagtgaaaccccgtctctactaaaaatacaaaaaattagccaggcgtggtggcatgcgcctgtaatcccagctacttgggagactgaagcaggagaattgcttgaactgggaggcggaggatgcagtcagccgagattgcgccattgcactctagcctgggtgatagtgcgagactcagtctcaaaaaaaaaaagaaaagaaatagatacttagtacctggcttcaaagaggttgtaacatctataaggagccaaatcatttctaaagattaatactaatataagatagcatatttgcattgagtttaaaggactcagacacaattgtactgactacctgcaacctctagaattagtgtagagttgtgatgcttgtagagttccttcatcagataaataatctttgttggcctttattctcaataggtttcactctttcaaaaaaaaatcagtaattgcatcgcaagtctgtcagataatactttaatttagaaagtctttttgaaatcagttagtttggataatacagcattacagttccataaagccaaggtctccaaaaatcaatgcctgtgcttaagaatgtaagttacattaacttcattctttaacaccatgaaacatataaatttcaatggaagaagtgtttctgggcactggcgttttatgaacgggttatacatatatctataagaaatgtgtgtgcatgggtgttcagaaacattataacaatgtagtttagatatgagtaatgctggccaattgggcacatgcaagtttggtttcctgtggaatactacctatttcagtatgcctctccttattttctggattcttaagttgctatagtttttcccaaggatatatacatatacatggatgtttatactaggttcttttataaaagagctagtgacatggaatagtcattctttaaaatataacaaaaataactggtaaatgtgaaaattagacttggatacctatatatcaaaagctacccttgagtactttcagagacccaataggaaaaaaaagctcgtataagtgattattgccttcacattagcacccagtttttcaaaatggctggtacttgccaatatgcaaacagaagcataatgttttactaggagaatagatgttataaagatgttgaaaaatgaacaccttgaattcattaatcttaaaaacattgcagaaagggagcaaaaaactatgcctctgtctcctctcacgtgctaagaaacaagaatgatattaaaaaattagagaactgaataagcttaccttagccacaatagcaaagtaaaggaggaggaataactgaagagatcatagcaacagagccattgctggttgcctgtgttagctgtgaagagaacattggcaaattaaatatccaggcctctgtaaaaccactatctaagcttcctccatttatctaagcgaggctatcatcaccacccacttcttctgttgcctactgaactgctaagaaataatacattttgcagattttagttttattgtctttattttgttctttcttatttcccccacttcaggggtcttttaggagatatttcacaactatagataaaatttcagagctggatggaagcctaacaatacttaactttttttactccaacttgcatctagttattgcacttacgtgtttccttgttgttcagcgtgttgttgatttttgaacaatactgtttacttccttgattagctctctgatttatagcttaggtaaagctcacacatgtcctggccacagatatcacacaatattttattttggcaccaggttgacattacacactgttcgttgtagttccatttcagagaacagtccacccccatctacaccacatgcctggcattgatctaggtgaagctacatagccacaaagggtgttcattatggacaccatgacggaatgccatgacacacaagtgcagaaccactgatcttctcaaactcctcatttgacatataatacaaatgagtcataaagagtagacatgatctccttaagtcagtggcaggtgtgggataggaatccaagtttctcactttccagtgtccttttcattgcttccatgctaaagagggaaactcaaaaaagcagttatagttccaagcactgaatcataatcctgcacaatgggaagctaacagcgtcttgtttgctgaagccctgtgtaactttctcaggcttaaaaacacaaggaagcataggtgttgcgggaaattatatgactgacctaccaccaatagataaggtatgttgtgcaaatcttctagggagggattttttaatttgcagtgatcagttgatttgctcctgcctgagcattttatttaggattctattcttagactgtggaatgtaacttctctgtatgaaactacctgacccatatgagattttacttaagactttggccatatcagcactattttaactggaatgagtctcctagtagctcgtatccaaaccatccacctttggccacacagatgaatgggcattctacctgaaggccacctgaagagcagaacaagcttttgttcccagtcccaccagtgacttatgataccttagcaaagccttcttccccatattttcttccccctaaaactgtccccacaggtggtattttcactggaagggagtggtgagtaacttgtttttatgtttgcaagggtaaaataataaatgttttaatgctattattaaatgtctaattttaaaataagaagcctcctagaaatttgtcttacaagctctctggaactctctggaaccctcaggtttacattctgtatctgtcttgcgcatgtctttcagatagaataccttccatttcctgtcaaactcatgttaagctttcacaatctagctcattcattgactactcttcagtttttgttttcctcatcctctcatgaaaacttagtattctgtccccttgtgtcactttattcagagatttattctaacactcaccagtttcaatcgcaatgaattgtttatatgtcagcctttccccttccccccaagagcttctctgggctgtcttctccttaaaacaaagaactgtatagttggctcttgaacaatgttggtttgaactgtgcaggtccacttatacacaggttttttttttttttttcaaacaaatgcagataaaaaatacaatattggttggatgcaaaactgcatatatggagggccaacttttcatatatgtgggttcttcagggctgagtgcgtaggttttggtatactagggggtactagaatgaatccctcatatatactaattgcattctattcatctttataagacccatagaaggcctttactgtattatttcaaagtatgaataacatgagcatcattaaacaaaaggtcccctatttcaaaactgtcccccttacctggacactagatcatctacaggttttcaacattcccatcaatagaatcattccataaaaatttttttttctggatagctttttttttttttttgagacggagtctagctctgtcacccaggctggagtgcagtggcatgatctcagcttactgcaatctccgcctcctgggttcgagggattctcctacctcagcctcctgagtgactggtattacaggtgcgtgccaccatgcccagcttatttttgtatttttagtacagatggggttttactgtgttatccaggctggtcttgaactcttaacctcatgatctgcctgcctcggcctcccaaagtgctgggattacaagcatgagccaccgcgcctggcctagatagcttcttataccatataaacatctcacctgagtgaattaataaatttctttgtccattaacaaattacacctggattaagtatcagaagaatagtaacctgaaggtttggaacaaaaacaaaaggagatttgatgagaatatggaggaggtgtgtactgcatggaaaagttcaagggtgggacaatgaagtagggggaattagatattgggatagggaggagacagcattaaagccatgttgcaccttcagaagtggaaatagagaggtgaaaagggatgtggggaatttgaatacatcctttgcctaaattatgattttgcccaggaccatccctgattgctctgagattggaataagccattctcacacctcatgacatgggtgctgacagacatgtgtatgtggcttttattttattgtatttttaaatgggtcaggtcttcttgggtagatattgggtagatgtcagtagtataggctcttgtacttttgtgaacacacatcaggccatgtgacagccatattattttcaagcaaactccaccaagaaaataatgggaagagctttcttcatctggctctaaaaggaaattctcctcgttaaaagagactgacctactgccgacgtggcaataaaatgcagaaaacagagcaactccactattgactgtgttaggaaagagaagccttgttagctccttgaaacagtctgggattcagtatagttgtttgctggactgacatcctgtttatgagttttaaagcttaaggagaaaggaaggagttaactattttttccctagctctacaatttgagatctctgggtcacaaatctttaaagctgtagtttatattctaaagaaaaaagtcagtgaaaacattggtttggctttctttaagcaaatagtgtaaaggtgttaattatgcagaaattccttaaaatgccagacaattaccaattaaaagtcaatacagtaatagggaagggatttctttggggctttgaatttgccacatgcaagataaagttgtagattcagaaaagagagtgaatttgttatctgtgcatacctttcttcaataaaaccgatgggaggatagtctggtctcttacttactcttgattccttccctccacaaaactacaatcccttctatatacagttatgcatcacataatgacatttcagtcaatgacagaccacatatacaactgtggtcccataagattacaatgcagctgaaaaattcctattgcctagtgatgtcctagcctttgcaatgcattactcaggtgtttgtggtgatgctgatataataagcctactgctttgccagttgtataaaatataacagatacagttatgtgcagtacatagcactgaataatgataataaacaactatattactggtttacgtatgtgctatagtaggcttttaagttattattttagcatgtactcctacttatttttttttaagttaactataaaactgcctcaggcaggttctttaggaggtattctagaagaaaccattgtgattataggagatggcaactccctgtgtgttattgccccatagaccttacagtgggataagatgtgtggaggtagaagacagtgatattgattatcctgaaactgtgtaggcttcagctagtatgggtgttagtgtctttgtttttaattaaaaaattaaaaagtaaacaaaaaaatcttaaaaatttaaaaaggcttatagaattaagatataaagaaaatatttttgtacatcttacaatgtgtgttttaagctaagtgttatttcaaaagagtcaaaaaattttaatattttaaaagtttgtgaggtaaaaaaagttatggtaagtggttaatttattatttaaaaaaaaagaaatttttttttttttttgagacggagtcttgctctgttgcccaggctggagtgcagtggcacgatctcggctcactgcaagctccgcctcccgggttcgcaccattctcctgcgtcagcctcccaagtagttgggactacaggcgcctgccaccatgcccggctaatttttgtatttttagtagagacagggtttcaccgtgttagccaggatggtctcgatctcctgaccttgtgatccacctgcctcggcctcctaaagtgctgggattacaggcgtgagccaccatgcccggccaaaaaagaaatcttttgtataaatttagtgtagcctaagtgtgcagtatttataaagtctacattagtgtacagtaatgtacactaatgtactaatgtacagtgaatgtaatgtcctaggccttcacattcacacatcactcactcactcactgactcacccagagcaacttctagtccctgcaagtctcattcatgttatgtgccctatataggtgtactgtttttttacattttataccatatttttactgtaccttttctatgtttagatacacaaatactttccattgtgttataattgcctatagtattccatacagcaacatgctatacgggtttttagcctagaagaaatagcatagcccaggtgtgtcaaccaaaacaaaacaaaaaaaagagaaaattatccataaatatgctgggtttacttaggaataaaaataaggattataatctggaatggtataaaatggcaagccaccagtgcattcagtgagggaagggtaaggggaggttttattagcaaaaagagatttatataagctgcttagaaatagagttcattggttccagaagttcaaagccagagttgtcagttcactggtggagatactgttactgggcaagtgttcttctgagaatatcttaactgaattacttcagtcctatagaatgcctagtaataaaccttatcaaagtgggagatgcatgaaggatgcaaaagggttttttgtggggtttttagaaagtccttggaaacagttcttatctcagacatgtaagcatgagcctcttctttttcgggccttcccagccctatcttgtctgggtctgacaaaagtgatttcatcctgtatctgtaactttcacaatgtgcagaggctataccatctaggtttttgtaagtacgctctatgctgttcacataatgacaaaattccttatgactcttttcttacaatatatccctgtcgttaagcagcacagcacgtgactgtatataaattatccatgttcttttcataagacattaggtcatgtccaagtgggctgggaactcttccatcctgctctgcccatttattgatattaacgtgaaagctgtagataaatgctaagggagaaagtaaaaactgcagaacaaaatttaacattacacatgatctccttttcttggcttcctacagctgtgtcatattttgtggctatcttaagttacttcaatttatcgaatctaaaataaatccttcttataaatttaggagagatggttatgtgaagatgaactaagattttttagtatacaaaatactataggtttgtgtttttttgagaatgggtcttgctctgttgcccaggctagagtacagtggtgtgatcatggctcactgcagcctcaacctcccgggctcaacttgttatatataaagttttggtgctgcaaaaggaatagcactcgaatataaaattttctttttgattctcagcaaggcaaggtacttctgtatagaagggttcacccttacagatggaacaatggtgagcgcacacttggacaagggaggggaaggggttcttattcctgacgcacgtggcccctgctgctgtgtcattcccctattggctagggttagaccacacaggctaagctaattctgattggctaatgtaaagagaatgacgggtgagtgctttagtgggagtcagggcagagaaggtagcaggtaattggaatgagttagggtggagcaggtgatcagaatgagtcagggtggagtaggtaattgaaaaaggttgctttacgaggaagttaagtttagaaggcaaagaattgaacatactgacatattctttgaaaagaaatttagaactcatatctaacaaacagatcctaccacttcagcctcctaagtagctgggaccacaggcgtggcaccacgcccagttaatttttaaaactttttgtagaaatggggtctcactatgttgcccaagctggtctcaaattcctgggcttaggtgatccttccacttggactccccagattctgggattacaggtgagagccactgtacttagctactatagtattttttatagtatgtttgtatacaactatgtactgaatttaactccttgcatttttgttagctacagtgttataaactgaaattggaacatgttaattactgcaagtattgcactagcgtaggtctgtctcaagcttgctcccaaacattaccagcccaactcactgataagataaagtggaggttattgcttcccaccacctctcaaagctttggcaatgtcttggagaagggaagtcaaggtcagagtttgttgagaaatcgtttatttttaggagggtctttcaaagtgagggcctttgattaggactgggtaaggatcatagtgcagcagtccagggctggtggaaacagcaaggggaggactttgaaaggagagatgataggaatcataggtaatgaactgtcaggttgatcctttccatggaagagctgatgagtctttcaggaagtttctgtaatgagcaatctaaccatttgcctgggcttggagactcctgaaaaaagaaagtcctactaatggagacaggaattacacaaagtcatcgtattgtagacagtaagatgtggtttccgttctcagtgtctaagctgaatgtgggctacgtggtttcagttctcaggtctactgcgatataacttaatcttgtaacagatgaactgaagcatctgatttttatttactgctccttatctttgtagctatttgacacaaacagctttttacatttcagcattgctttgcaatcatttcttagtttattagcctatttcttgtgtttggagagaaaattaaaatcggaaaatttctcaaacaaatgcccaccaacaatcaccactggaacccagctacaagtcctataaacccagagggtgcagcagagggagactgaattctatgtttgattatttaatacaacaacctgtcctttggggcagttagtaaaagatgactacaggtgacaccctgggttctgggtactttccaagcaaggaaaatcctctgaagcaggcggaaaattgccgtcttttaaaagttccagctctgtcttcagaccacttgtgtcttttcttttaagttggaagcagggaaattgtgtgagatctttgtaatctccaattcagattctctcttaacacagttcccacataggatataaattccattagatgcctctgacttccgttttctccttccaacacaggacacatgttggtagttgcagttttgagaagcacagaagggtgttctggggcaatgagcaatgcttagctgggaggaggctgtctagggggtgaagcactgaggatgcttaacatttgaaagaagtgtgaacactatttacatttaaattaaaatggaaactttggttatgtttctgaaaggtgtgtgtgcgcatctgctgaggtctattgtttattcatgctgtaaatcctttgaaatgtgttaaaatgcttcccactcattataaagctcctgccacccctggattacgactttgatgtcaccaatcctgcttcaaagggttctttctgggctattaatcacagtttagcctctgaagatatcgccagagaaaacatttggacatctttgtgctagacttgctgaaactttgaaatcttgagcatcttgcatatgcacaaattgcagcacttcctttcattaacaactttttattttgctacagaatcaaatgacactgtaggtaaaaatgcaaacaaatctcttcacacacttggtttgggggaagaacaatcagagaagtggtgaagggtgtgtggggtagtgaacaggccattcagactcttcaaaggtaaaaagtgggaggaatctgagtagccaagagttgccctatcattttttctcacctttcatagtttttttgactagccagtgatcacacagagatttggtgcgatttcctggtcttttcttgctctctcctttgagacctttgtgaacagttcacagcaaataataataaaatactacctaatgtgaaatgaatagttgccctgctctagtcctgtgttggcagtgctttttgtaagttgtcttgttgaatccccataataactcttatgggaggaaaacaggtggtactgttttcttattatggactaggaaactgaggctttgagaagtcaacttgttcaaagtcacactcctgacaaatgcaaagccctgcaaaacttcattggcccccaggactcagaagctgctgtctcccactccctaccccactgattcactgggggtggccaggtttctccttacgtgcagagagattgatggggtttagggctcactgtcccaaaatatggccccttgacctattgaatattttaagctgaaggaatttgagaaaatgacagatgcaggaatgtcactcttagcccccacccccttctcccttgaagcaggtcataaaatctaggaaggttttttctgaccttctcctaaagcaggctgtaagactctcatgtaggagctgctcttcctatacccacagaaaagaagcgtctttatctctgcggacacaaggacacagagaagaatctgaacaaataggccttgctaagtttcattagtttcttaccattagatgatactttttcctatcatatttctttactactctcctttttgtttccttataaaggctctagtgtcaactaaaacttacattaagtaaatttttatgcttttcacttagtaatctgtcctttgttataagtgcctcaaccatgaacctaggatgggtagagaaaaagatatttttcctcccctgaaggatccttactgcccagtctactaatcagtgtctgtgtcctcaaccctcacaatggcgcgctctatcgtctaacttctttctcgggaaaacttccttcagcaccttttttcttccatattcatctttttcaatgattagcagtgtcccagttggagactttttcttgttgttgcagtaaaaaatatatataacatgaaatctctctttttaagtatacaatacagtatcaaatatgtgcacagttttgcacagcagatctctagaattttttcatattatgtgactaaaactcaatacccactgaatagccactcccacttcctcgtgtccccagccactgacagctaccattctactctctgcttttgtgagtttgactacttttgatatctcatgtaagtggaattgtgcagtgctgtgttgctgtgactggcttatttcacttagcctaacgtcctccaggttcatccatgttgtagtgtatggcaggatttccttgtttttttttaaggctgggtattcaattgtatgtatatatcaaatgttctttatccatttaactgttgataggcatttagtttgtttatacttcttggcccttgtgaataatggtgcaatgaacacaggagtgcaaatatctcttggagatcttgttttcaattcttttaggtaaatactcagaagagggattgctgtatcatatggtagatctatttttaattttttgaggaaactttatactacattttccatagcagctgcaccattttatattccccccaatagtgcagagagttctaatttctctacatcctctttagcacttgtttctgtttctttgatgatgaccatcttaattgggatgaggtaatatttcttttttttttgagacggagtcttgctctgtagccgaagctggagtgcagtggcatgattttggctcactgcagcctccccctcccaagttcaaatgcttctcctgcctcagcctcctgagtagctgggaccacaggcgcctgccaccatgtctggctaacttttgtatttttagtagagacagggtttcaccatattggccaggctggtctcaaactcctgatttgtgatccaccagctttggcctcccaaagtgctgggattacaggtgtgagccaccgtgcccggccaaggatgaggtaatatttcatctcattatagttttgattttcatttccctaatgtttagtgatactgagtatctcttcatataccggttagccatttgtatgccttctttggcgatatgtgtagtcaagtccatatttaaattgttttttttttttttgggccaggcatgatggctcacacctgtaatcccagcactttgggaggctgaggcaggcggatcatgaggtcaggagattgagtccagcctggctaacacggtgaaaacccgtctctactaaaaatacaaaaaattagacgggcatgctggtgggcgcctgtagtcccagctactcaggaggctgaggcaggagaatggcgtgaacccaggaagtagagcttgcagtgagccaagattgtgccactgcactccagcctgggtgacaaagaaagactccatctcaaaaataataataataataataattttttgttatttggcttttttactattgagttgtaggagttccttatatattttacacattaatcctttattagctatatagtttgaaaaaagtttctcctattccatagcttatctctacaattcgttgattgtttccttggttgagtagaagttctagttttatgtagtcccattgtctatatttgcttttatagcccatgttttggtttcatatccaaaaaaattgttgccaagactaatgttatgaagcttttctcctatgttttcttctagcagttttatagtttcagttctttttttgagacagagtctcgctctgtcgcccaggctggaatgcagtggtgctatccctgttcactgcaagctccacctcccaggttcacaccattctcctgcctcagcctcccgagtagctgagaccacaggtgcccaccaccacgcccggctaattttttgtgtttttagtagagatggggtttcaccatgttagccaggatggtctcgatctcctgaccttgtgatccgcctgcctcagcttcccaaagtgctgggattacaggcgtgagccaccatgcctggctatagtttcagttcttgcattttaatcttcaagccattttgatatgatttttgtgtatggtataaggtaacagttaaattttattcttttgtatgtggatattcacttttcctaacactgtttgttgaagagattattttaccccattgtatactcttggtgattttatcaaagatcatttgatcatgcatctgttgtgtgtttatttctgggcactctgttttgaattcaggaaatgtgagtcctccagctttattctttttctcactgttgttttggctattctgggtcctttgtggttctatatgaattttaggatattttttctatctgcaaaagatgccattgggacttaatagggattacactgaatctgtagaatgcttgggatagtatgaacattttaacaatgttaagtcttccaacccatgaacagtgatgtccatcagtttatttgtgtcttctttaatttctcccagcaatgttttgtagtttttggtgtaaaagtcttttgcctccttgattaaatttattcctattatattttgatgctattttaaatggaattatttccttaatttcttttttgaatagttcatttttagtgtataaaaatgcaactgaattagctgggattggtggcgcgtgcctctaatcccagctactcaggaggctgaggcatgagaatcacttgaatctgggaggtggaggttgcagtgagctgagatcacaccactgcacttcagccagggcaacagagtgagactctgtctgaaaaaacaacagcaacaacaacaacaaactgatttttgggtgttggtttttttttttttttttttttttgagacggagtctcgctctgtcccaggctggagtgcagtggcatgatctcggttcactgcaacctccgcctcctgggttcaagtgattctcctgcctcagcctccagagtagctgagattacaggcgcgtgccaccacgcccggctaatttttgtatttttagtagagacggggtttcaccatgttggcctggctggtctccaactcctgaccttgtgatccacccgcctcggcctcccaaagtgctgggattacaggcgtgagccacctcgtccagcctgggtgttggttttgtatcagcaattttgctaaagttagttctaacatttattagttctaacacttcttttaatgtggaatctttaaggttttctacatataaaattgtgaacggacattaattttacttcttcctttctgatgtggatgcctttcatttcttttccttatctaattgccccagctaagacttccagtactataatattttgaatggaagtggtgagtgtgtgaatccttgtcttgtttttgatcgtgtggaaaaagctttcaaattttcactatttggtatgatgttagtgttactggaaagggatcccaatccagatcccaagagagggttcctggatcttgcacaagaaataatttgggatgagttcatagagtaaagtgaaagcaagttcattaggaaactaaaggaataaaagaatggctgctccataggcagagcagccccaagggctgctggttgcccatttttatggttatttcttgattatatgcttaataaggggtagatttgtcatgagttttctgggaaaagggtggtcaattcctggaactgaggggtcctcccccttttagaccatatagggtaacttcctgatgttgccatgcatttgttgtcatggagatggtgggagtgtcttttagcatgctaatgcattataattagcatataatgaacaatgaggatgaccagaggtcactttcattgccatcttggtttcggtgagatttgaccaggcttttctttttttaactgcaacctgttttatcagcaaggtgtttatgatctgtattttgtgccaacctcttatctcatcctgtgactaagaatgcctaacctcctgggaatgcagcccagtaggtctcagccttattttcacccagcccctattcaagatgaagttgctgtggttcaaatgcctctgacatttcactgtgggattttcataaatggccattaatatattgtggtaatttccttttatttcttttttttgtggacatatatttttatttctctttggtaaatatctggaagtgttatctcggagctatatgaatttatgcttactttataataaattttccacctgatttcaacagtagctctaatattttgtattcctatcagcaatgaaggttccagttgttcctaatacttgtgaacacgtgttattgtctgccttttttattttagccataatagcaggtatgtagagctgtatcattatggtttttatttctacttccctaatgactaattaagttaaagttatatcatgtgcttatttgccctttgagtatcttcttcagtgaagtttctgttcaaatatattgcccatttattaattgattgtccctcttcttgttatttagtaggaggtgttcttttttttttttttttttaattatacttgaagttctaggatacatgtgcacaacgtgcaggtttgttacatagtatacatgtgctatgttggtgtgctgcacccattaactcatcatttacattaggtatatctcctaatgctatccctccccactccccccactccccgacaggtcctggtgtgtgatgttccccaccctgcgtccaagtgttctcattgttgaattcccacctatgagtgagaacatgcagtatttggttttctgtccttgcgatagtttgctcagaatgatggtttccagcttcatccatgtcactacaaaggacatgaactcatccttttttatggctgcatagtattccacggtgtatatgtgccacattttcttaatccagtctttcattgatggatgtttgggttggttccaagtctttgctattgtgaatagtgccgcaataaacatacatgtgcatgtgtctttatagcagcatgatttataatccttcaggtatatgcccagtaatgggatagctgggtcaaatggtatttctagttctagatccctgaggaatcgccacactgtcttccacaatggttgaacagtcccaccaatagtgtaaaagtgttcctatttctccacatcctctccagcacctgttgtttcctgactttttaatgaccgccattctaactggcgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgattttttcttgtaaatttaagttctttatagattctggatattagccctttgttagatgggtagattgtaaaaattttctcccattctgtaggttgcctgttcactctgatggtagtttcttttgctgtgcagaatctctttagtttaattagatcccatttgtcaattttggcttttgttgccattgcttttggtgttttagtcatgaagtccttgcccatgcctatggcctgaatggtattgcttaggttttcttctagggtttttatggttataggtctaacatttaaatctttaatccatcttgaattaatttttgtataaggtgaatttccttttatttctaatttgttcagtgaatttaataattttatgttctttttgcttataaaatgaatataaattcaatttataagttacaaattattttaaacttataaataattattataatttataatttatatcatcaaagtgtcaaaattttccaaattttaaaaattcagagcagattgttttgaaaattcagaaaaatacaaggacccaaagggaaaaattactcatgatcctatttcttaacttttcctttaatttatgttctttgtggtctctttctcaggtaatttggcccagacaagagctaggataacagtggcctcaagttctttgcctccacatttcagtgctgggaaagccaaggtgagtaacagatttgcaccaaatatagtatggactggcaggtactcttgacccagggataatcttagagtgggcagcattagttcccttctagcagccctctgcctgggcagtctagtagagagattaaaggcatttaggaaatcaggggttaggaaattggaaacatcatggaatccttacaatcctgattctcagaaagagcacttaagaacaatgctacctgaaaaaataaagtctaagaaaagataaagcatttctctgacactaccagcaagctagtggaccaaatggaatcagggaggaaagaaactacagtgtttcctattgctctcctttgccctctgaaaaatgagttgtacactcatctgtgcaaaggagttattagaagggttaaaaaatatccagctgtaaaatatgtctttaactgttctatccttccagctaaagtttaacaagagtcttaaggactgcttcgttaatattcattgtaagtgccaacagagaaacacagttatcttgaaggtgttggagtaaaggctggtcacgtttctgaattttcttatcttttggtttacactgaaaatttatttaataaagaataaacaatttggccacacgttaatactgttgaatagtattccaaaattgatacagatgtacatatttatatttacttttcttgagaataaaagacttatttgcagagtgggaactcaaatcattttttgttaaaaataattttttaccaatattgctattataattcattgtaataccctacatttcaaccttgctacttcacggcaaaacattagtactatctgggcctctagaaggatttacacaggagtttcagtggttctgatggcctcttgatagcgcatgtaaaattttatctgtatttaatacagttggttctcattatttgtaaaagttgtgctctctaaagttgctgcaaactctgaatcagcaaatactgaaccattgcttccaggaggaaatacggggtcaatacttaggccacaatatttttgtgaagtgatcaatgcataacctcattttacacatgtttctgttaaaagacaccctatttaatatatgtttattctaaataattatagtcagtattttaaaatataaaacagtatgtcaattgcagcatttgtgtcattgaactcacaatcaatagcactgtaacacatgcctgaacaataagtattttctccatgaggcatatcacaaccttcttgtgcttagaaacactagacagcaccacacttgcggggatacattttttttttttatttttgagacagagtttcactcttgttgcccaggctggagtgcaatggcgtgatcttggctcaccacaacctctgcctcctgcattcaaacgattctcctgcctcagcctcctgagtagctgggattacaggcatgcaccacctggcctagctaattttgtatttttagtagagacggggtttctccatgttggtcaggctggtctccaactcccgacctcaggtgatccgcccacctgggcctccccaagtgctggattacaggcgctcgccaccacacctggcccatttttttttttagacaagttctcactcttatggtccaggctggagtgtagtggcatgatcatatctcactgtaaccttgaatttctggcttcaaggatccttccacctcagcctccagaatagctaggactataggtgggcaccaccatacctggctaactaaaaaaaattttttttgtagagatgaggtcttgctatgttgttcatgctggtctcgaactcctggcctaaagtgatccttctgccttggcctcccaaagtgctgggtttgcaggtgtgagccaccacatccaccctgggttgggcaggggtcgggggcagcattttaaacagcaaaattaccaatggaaaaatcacaaaaatgcaaaaaaaaaatgtggtacttaaacagacctcaaaaaggacacttgtttatgagagctgaaataagaaggcagagcatcatcttctttgacatcagctggaaatgtgtgcgtcaggggactgagcatttctgtgaatgaccatgaaagcattgcagatattgactttgggttacaaataaattttagcaagtaggcaaatcctcagataatgaagatggattgtctttgtggttttttggagtcactggcttccaccagttctaaaagggattatgacacagaaacattaaagaaccccgtgtcgtatttcctgtcaacccacattcctctcctttcctctgtttgatttttgactactggactaaggcatatcccctgccttccacacccatagtaccagcaaagtgttgcctccctccctgtactatctaccatggctcagaccctgcccacatgaaaagtgtgccttctagtgtgtggcatatatttacgttattaataataatgtgtatgggtctgatgaaaatgactaaagatttgttttcacttagaaaatgagttgaaaatcctaataattaaggcatcaaaaatatgaagtgcagtaatagcaataaaaaatgaaacaaaaccaactccagttactatctgacttatccaaggtaaaattacagaagtggccctggataaagctcggctctgtaagtgtgggggaaaagtaatattgtttcctcacccatcaaaaggtttatggctgagacctctataacaaaaagcagattaacaagagaaaagcctacaaatttatttaatataagttttagatgacatgacagccatcagatatgaagacccaaagaaacagggaaatctgtgtatttttgtggtcagttgtacagaattatgactgaaaaacaaaagggtatgatttaatggtattaaactggagcttacttagcaaggactgtttgctcaaattcttcttggtgtccctatatgacattccttacctctgggtattccttacctcaggtcaggacatctgtcacatgagggtcttcaggggagaagggagggagaatggcagagagtgaccttcctaggtattctggcctgcttcagagaagagctgtgggaaggtgagagtggccttcctgcttctgctgtttaaatgcctaagtcccatgtttggggatagcatgtccttgactctatcagctccaacacatggagcagcactgcacagtcagttttcaatgtgtcttgctttctattcagtactctaacgatgtttgagaccagtggtgctgtcgggttttttttcttcttcttaagggatagatgtatcacttgatagcaataaaaattcttctaaagaggctttgtcaagaagataataaatatgaacacttctgaggcttcagcatgcaaatagggagcgctaactaagaacaggaggaaattcttcagttttcatttattgccaaaatctagatggtttatgggattctttggagtctatatctgtatccaagagtaaacttagttgacaaatgaggcaaatctttttactgataccgtgctttcagacttttattttataagttatataaaccacatcgggtggtgtaaccacccagtgggttcatcttggccactgcctagacagagccaattgatcaagatgggaattgcaatagagaaagagtaattcacacaatgctggctgcgcaggagaccagagttttattattactcaaatcagtctcctcgagtagtcaaggattggagttttgaaggatactttggtaggtagggggcaagtcaatcaggagttctgattggtgaggccagagatgaaataatagggagttgaagctgtcctctggggctgagtcagtttctgggttggggctataagaccagatgagtcagtttattgatctgagtggtgccagctgatccatcgagtccagggtctgtaaaatatctcaagcattgatcttaggtcttacaatactgatgttatccccaggagcaatctggggaggtttagagtcttgcagcctccagctgcttgactcctataccataatttctaatcttgtggctaatttgttagtcttgcaaaggcagtctagtccccaggcaggaaggggatttgttttgggaaagggctgttattgtctttgtttcaaagctaagctataaactaagttcctcctgaagttagttcggcctacacccaggaatgaacaaggacagcttggaggttagaaggaagatggagtcagttatgttagatctctttcactgtaataattttctcagttacaatttttgtaaaggtagtttcagtccctttctttgggttttgtaacaccttattcttcagatgtgggctatgaagatggaaaaaggatgaagaccactctaacatcttcctgctgaacagggggcatagtggggttaggtattgacccctaggtaagaggagtagaactgctttgcagctgtctgcatgtactcataggtgcctggttggggtttcaaggcttacatgacaagggtgttagtatcctcatctatagttttaatgcatttatagaacaacatactatatggtaaataatgcattctgggataagcagtgcaattccaagttttaaaagtaaagatttgaaagcattagtttggggacttgtagctcacagataatttagaatttaatccaaattgcagaaaataataaaaactcaagaacaactaacaacaggtgtgcgatagtttttttttttttgaagtataatttttctctcacgagtccccagttttactaaagataaatcatagtaggtcaaatttacttgcaaaataaattttagccctattatgcttggcttgattatttgcataaagtccagtaggaataattatttgccatataggatcttttaaaattggctttgctgaaactttgttctacaaggaatctcagattgtacttttaaagccttgaagcccagtcacagatttatgtatgcctgcaaacacctttatgagttgagtgaattttcctcctctgaaggtcctaaggtaacttggtgctcctgggcctgtcagaaagtgacattctttatttactacagatcaggaacccagtacacggactgtgtagacaaggtatgaggccagctttccctttattagctctataagtcaactttgattatttaaagaaagcatgccattccagtcaaagcctggtaaaataaccagtttctccagttgtgccctgttacaaaagaaatgagatttttattgcagttatgcaaaaaactagactgccataagttgagaatactcacaaatagtttctaaattctggaggaatcaggtagagagaaagcaatatgctccaaatttcattcatgggagtatactttactcaattgctaaatgttctaaataactcaaaaaaaaagttttcttggctgaacacagtggctcatgcctgtaatcccagcactttgggaggctgaggtgggcggatcacctgaggtcaggagcttgagaccagcctgaccaacatgaagaaactccatctctactaaaaatacaaaattagctgggcgtggtggtacatgcctgtaatcctagctactcgggaggctgaggcaggagaattgcttgaacccaggaggcagaggctgcggtgagctgagatcgcgccgttgcactccagcctgggtgacaagagcagaactctgtctcaaaaaaaaaaaagaaaagaaaaagaagaagttttcttgactctgaaaaacaaaaggattcgcaatgtttatcacatcagctctccataagtcctagaagtttgttttgtttcctctattccaataacacaatttctacattatcagagacctgcattcaagagaacccatcagagccctatatctgattataaactgccttctgaaaaggatcaaaacaagacaactgtctgtggatgacaaaagtcttaggacagccactattaaagctacaactgactaggaattttggttacttctgtggcacacaacaattttacataataattaaaaggcttaatatacattaaattatatcagaattatagaagcttcctataattttggaacacatacaaataacatatttataaaaatacagtccaaagaaagccaaacatcatttcatatttgacagtgtttcctgtgtgatttttatataagaaagcaaatacatcatttttgcactttaggggacctaatatctaaaagattaattaggtcagaaaaagacatactttataatttaattttggaaagtttgtcacatatcaaaggtttacaacactggatatcactaaatagaatcccaggtcaccgtaagtcattcatttagccaaaatgataacccagaaattttaaaaaggaaaagacctgtactctgatagagaggagactcagctttctagacaacaagatcctatgaagacagcatgaggccagctgaatctgtctcttctctctcccctcccttttttttttgtagtttactcaaaaggcaaacaagatttgttttcattgtctctaatattacataaaaatctttttcaaaagagaaaactaagtttcatgtttgctttagggcatctttaatgctaaagctagtttttaataaaattttataaatttatgcagttttaattagtttgaccataaggtaagattttcataaacttcttataactctttacaattttctgttaaacagatcaatttttttaaaagaaaaccctgctattcagacacatgggcccagattctggctccacatcagtgtgcttttattttaatgtttgagctatagaaaaatactaaacaattcccttcaactcttagccaacttgctgcttctcacagaacttcctttatcagatcaacccttcacaaacctttctaacttgcttaaaccttcaattttgtccctttactcttttagtttaagacattctttaaaaccctcttaactagacaaaattacattccctttaacaaaaaccatattcccatgccttcttataatttcccaccaaaaccacattctactttccttctataccttgcaaccttgcatgtaaaactctttttccagtggactcaagtacatgttacactattaactttttgcatctttcatttttggtgaaaagcctgataagtaaatgattttaatatatactagctgtggagcctaggacaccagacagaagtacaaataaggtttgattcttcctagtacaggtaggcggcatggcttacgccacatgtccctaggccttatctagaacctaatgactccaaagtaggtaagtcaaacagttttcaaaagtcaaagaagcagtttattaccttaaagcattttaacaaacctaatatctgacctaatttagaccaaatgttttgaccaaatgtctaaattttgaagacatttttattttaccagtaatctttaaaattgtctttatttccgaaagattactaaagtcacatgaacaaaaacttaaagtttctatttttctaacaaaatatttgatttaagcccttatttttacccccaattgttcagagcactttcatatataaacatcacacaaacagacatgaatatacacagaaaagaagatccagtagttgtcaagattttcatttgtcaatagttggattactggcttcagggtggagcccttggaggaatagggtgaggaaagcttgcagttttcagggcctaataagcaggcacagctggaaggcaaaaacagatccccaaaattaagggtcccatttttatatcacatcctggatccccaaaaagaggaaaacactatggaagaagacagtacaacgcttttactgtgcattttattgcaaggcaacccaaagccaatcggcccattttgtaatcagcccatctacatgggagtctcatctctcagtggaaggtggggatgtttgcacaccttccagatggccaagcatgcttctctaatccaagcatgcaaagagccaagtatccctccataacagccaatatcccttaaagttgctatacaccaaggctaaaggctttcccataatgcaaagtaatttctgatacccccaaaagtaaaaaaaaaaaggttcaggtaacataacgtaaaaccaaacaaagccttagattttgagagagatctattcactttcaattcctggggttccatgaggaaaacaggttttttccagaatggggtctgtggtgccacctctgtttttccccaggagtccaggcttttgaaattcttaggttctctcatgtgggcatcaagagcaacaaaaagacaaaatggagaaaaataattccgtcaactgagaagaaaagcctttttcagaaaaatatgattcaagaagaggaaaaagataaaggccttttaagtatgtatagcttggatatccattttaattaagctgattttaacagtagagctcttttgttttttaaaaaaacttttaaaatctcttattccagactccagccaggaaagccaatatttttggcctttgaattctaccacaggtaagctcccagtgaaattaataagttttaactaaggttataacttaaccatggatgcataaagtgtctcaaagagacagtaaacagtttctttatttacaagatttagaatctacccaaagataattgagagaaataaaaaattaagacaggaaatcagaagccgtccataggggaaaataatcaataaatggcaaaaagttacacaaataacaaaccagaaaggactgatttcctaagcgaagaattgaacctaggctgccattgtcaaaaaaacaaagccttagctatggaactacaacattaagcatttcctattgttcttcccaaaagaggcctagagtagccaattttgagcttgcaaaggctttaaagtgcttaagataatttttaggactagctatgacatgaaccacaaaatccttgtcctctggatggcagagactaaaataaagtatccccacatggtcacatggttaagattttaaggacataaaacaacatgagaaacttcatccggtattggtttcaggggcctgcagcaaagtttgtaactgacaagcctgccaggctggcttgaaaagtaggggtttaggggtccacagcccacgttctatcctgtggcactgccgctccattacagaaagacaaattctttgcacaaagtacaccagatttgctgcagcctaataagacgagtttcacaaatcctttttttctattaatcatacctttgcagaagagactaacagtgatgtttaccatttacacacacacacacacacacacacacacacacacacacacacacgagagagagagagagaaagagagagcgaccaactgaccagaaacctggctggtaagaaattcttaccctttttgacagcataccaggtaccaggtttctgggctccctttctctgcaactttcagaagaacagagcagcttttgatgaccctgctcaccacaccatagctgtggggaccaagccccattacaaaagaaaatgatcactttctgttttatggaaccataggcaaaagctttctagttttgcaagatgctgcccgatagtctgcatgaggaactgaattaacattttccatcccagtctaagcaaaatacccgtaacaaaacagacactagtcacctcattccacacccagtattgacctaacaaggctcaaactttctcccattggtctctgtcatctttgatccacttaaggtgaggagggatgacctccaaccaggaattcaatgagtggtctctgggcaagacgaagagtggagaatcacagagtcaggcctgttgagctttcatcagggctaaccgaatgcaattacacttacagagggttcttcaagttaggcctgctggactttggttagcagtttcttcagagatccattccacgcatacaaacacacacacaacaaagacaagatggacagaaggccttccaaatcaagatcccttgccaagaattccaagagtattccttccaaactaacctcctattctccatctgagaaatctccccagaatcttcctgattgaggagaaatctctggaaccaagactcttcttactcattagggagggccagctgagaccttgaaggagccaaacctatcaggagaagggaggaggtgttggcagctcctagaatacccaccaaatcagacaccgataatggggctacagctacagacactccaagattgggctacagacagagacacaccctgcaatacggctccagttacagacaccctgtggtggagctacagacagacatcctaccatggggctacagttatgaaatgtctccgcaggactatttctctattgcaattaaattcatgcacattgggctggcagtgacctgccagtagagacagtgcccgagtcagcccctaatccaagagaactaggtggctgcttgggctggcctctggatccatcaaaggagaggggctaccgaaccacgggcaggtagccacaaaggcaatcccagaccagcccccaaatttgtaaccacctaacgggctcaccttgcccactgcctagacagagccaattgatcaagacagggaaattgcactagagaaagagtaattcacatagagccagctgtgtgggagaccagagttttttttattactaaaatcagagaatttggggatctgaatttttaagcataattctgtgggtaggggggacagtgcattaggagttctgattggtcagttcagagatgaaatcatagggagttgaaactgtcctcttgcactgagtcaattcctgggttgaggccacaagaccagatgagccagtttattgagctgggtggtgctagctgttccatcgagtgccgggtctgtaaaatacctcaagcattgatcttaggtcttacaatactgatgttatccccaggagcaatttggaaaaatttagaatcttgcagtctccagctgcatgactcctaaaccatgatttctaatcttgtggctaatttgttagtcctgcaaaggcagtctagtccccaggaaggaagggggtttgttttgggaaagggctgttattgtctttgtttcaaagcaaaactataaattcctcctaaagttagttcagcttacacccaggaatgaaaaaggacaggctggaggttagaagcaagatggagtcatcagatctcttttcactgtaataattgtctcagttataatttttgcaaaggtggtttcagtggcagtatataatgtttaagaaatatggtttaggaatcaaagtgggttcagatataggcatggccatctactggctgtaggactctgggaattctacctaaaatatgttagtcttaacttcctcatatgtggaatgggaagaataatattatttacctcataggttattttgagaatttagtgacataacataggaagtgtttagtacagtgatttcagataggaaacactcaatagatactgtattactcaagttttgataactatttaaaattccatgtgtggagcccatatgtatatagaagcttgctcaactgctgtggtgtagggactgtaacacaatttgtaaaacttactcgtgactactctgaaggctaatcattcacaaggaaccaaacaggatgtttatcatgtgggcagaaagcacgcttgctcagctccaactgacttacattgttttgtaagtccgtgttgtaggaggaaagtatactgggttagacagacaatggttttgtccagaatatggcttctattgatcattttgatattggtcttataggggccaagggaagacttcctcactctctgaaagtttgctgaaaataaactgacaagaggcagattaatatgagaaaatgcatacagatgtattaacgggaataggggagaatcacagagtgattacccaccagacaaatggtacacagatggttatatacccttcttaagggagagggagatggagaagtgtggatattttggtgggggggtggggcggtaaatgattttaggggaatttaatggccttgaagaacatacaatggcctgggacaaagtctgttaggtctgcaaaacaaacagtggtttgggacaagtctgtccagttgtgttgacagactgcagcccttcttcctgtgataggagtttagttaatgaaaaactcagggaagggatcacaggtaattgttttctttggtgggtctaggctttaggcagataaatgaatttcagagaacagcttcatcctgggctatgggagagacagaggattaagagatgggggttgggggtatcagagagaccttgattcttcttcagttcaacatgtcaacatggggtatatgaacccagttcaacatggggtatatgtttctgtaccccaacagtttcattagaactatttttcttaccaataaataaaaagatctccttgctgagttgcatggtagcagaactctccttctgccactgaacgcactttgcatccttgatatttaaaactacgctaaaactaaatcaatcacagtaatgatggaaggagaactaatgttatttgttatatgtgcgcaaggcagcagttttgactaaccaattttattaatgaggaaaacagaggcttttaaaagttaaatacagtcatcagtcacttaataaagtgatatattctgaggactctgtcattgggtgatttttgtcgtcgttcattcatagagtgtgcttacacaaacctagatggtatagcttactatacacctaggctataagctatcgcctttcgctgtgagactacaaacctgtatagcatgttactgtactgaatactgtaggcaatgtaacacagtggtatttttgtatctaaacatagaaaagatacagtaaaaatgtggtacaaaagattaaaaatggcacacctgcatagtgcacttaccatgaatggagcttacaggactggaagtcactctgggtgagtcagtgagtgtgtggcgagtgaatatgaaggcctgagacattagtgtacactcctgtagactttataaataatgtacacttaggctatactgaatttattttaaaatgcattttattcagtaataaattaaccttagtttactttaacttttttttatgaacttaaaaaggcctgtaaaacaaagaatggtttgggacaagtctgtctaaaagactttttcacttttttttttgtaataacacttagcttaaaacacaaacacattgtacaactgtacaaaaatcttctttctttatatctttattctataaacttctatttaaaaattttttacttttatttttaaaattttttgtgaaaaacaaagacaccaacacatacattagcctaggcctacacaggctcaggatcatcaatatcactgtcttctactaatgccacatcttgtccaactagaaggtctaacacgcatagtgtcatcatctcctatgataacaatgccttcttttggaatacctcctaaaggacctgcctgaggctgttccacggttaatgttttttgttttgtttttaatgtaagtagaagaagtacaccctaaaataattacttttttgtttctttgagacagagtttcgctgtgttgtccaggctggagtgcagtgccatgatcgtggctcactacaacctctgcctcccgggttcaagcaattatcctccctcagcctcctgagcagttgggactacaggtgcccaccactacgcctggctaagttttatatttaggtagagacagggtttcacttcgttggccaggctggtctcgaactcctgacctcaagtggtccacgcaccttggcctcccaaagtgctgggattacaggcatgagctatcgcacctggctaaaataatgattacaagtattgtaaatacgtaaaccagtaacatagttatttactatcattatccagtattatatactgtacattattgtacatgctctgcttcgatatgattggcagcgcaggtttgtttacaccaaatcaccacaaacacatgagtaatgaagtgcactatgacattatgtctacaacattactaggcaatgggattttttcagctccattataatctatgggactaatgtagtatatacagtttaccattgactgaaatgtcctacttctatggcacatgagtgtaacaggtgcatggccacacagctagcaagaatttcaaccaggtttgtcaatagcaatcactcagcctagaaaagcttttctggtctctttttttatcctaaggtaaagaacatatactttggagaggattttctctttgtcaaatccccacttttgggaagaattatttgctagatgatgccctaatagaacccactttccaggttgtttctaaaagcatttttggttaaaaaattaaatgatgctactactactataatgaaattagctcaggaagacaaactcttaggctacacaacagccttctcagcccttttggtttggagttttggggctggctttggagctccgtggaaggcctgatacagagagaggtctagtttaaaaggctgagagaagcaacttctggtttgttccttgtcggaaattcttttagatccattccaagttcaggagaaccttatgaatatgcaaatatacaagagatccctcaccaaccgaagacctttttaaattcttcaattagaaaatactccaataacatattgtgaattggtgggttcttggtcttgctgacttcaagaatgaagccatggaccctcgcggtgagtgttacagttcttaaagatggtgtgtccagagtttgtttgttcctcccgtccggagttgttcatccctcccggtgggtttgtggtcttgctggcttcaggagtgaagctgcagacctttgcagtgagtgttacagctcataaaggcagagtggacccaaagagtgagcagcagcaagatttattgcgaagagtgaaagaacaaagcttccacagcgtggaaagggaccccagcgggttgccactgctggctctggcagcctgcttttattccctaatctgaccctacccacatcctgcggattggtccattttacagagagctgattgacccattttacagagagctgattggtctgttttgacagggtgctgattggtgggtttacaaaccttgagctagacacagagtgctgattggtgcacttacaatcctttagccaaacacaaagttctccaagtccccactagattagctagacacagagcactgataggtgcatttacaaacctttagctagacacaaggtgctgattggtgcatttacaaacctttaactagacatagaagttctccaagtccccacccccacccaggagcccagttggctttgcctactggatcctgctgcaggtggagctgcccaccagtcccggcgccacactcctgcactcctcagcccttgggcagtcatgggaccgggcgccatggagcagggggtggtgcccgtcgaggaggctcaaggctcgggccgcatgggaacccactgggggtgggggggcttgggcatggcgggctgcgggtcctgagccctgccccacggggaagtggctgaggcctggcgagaatttgagcgtggtgtgggcaggtgggggacctggtgcaccttccgcagctgctggcccagatactaagcccctcactgcccgtggccagcggcactggccagccgcttccagtgcagggccgactgagcctgcccccacccggaactcatgctggctctcaagggacgcgcagccctggttcccagcccgtacctctccctctttacctccccgcaagcagaaggagccagctccgccctcggccagcccagagaggggctcccacagtgcagtggcgggctgaagggctcctcaagcgtggccagagtggatgctgagacagaggagtcgccgagagtaagcgagggctgctagcacgggctgctagcatgttgtcacctctcaatatcacctattctaggccgggcgtggtggctcacgcctgtaaacccagcactttgggaggccgaggcgggcggatctcaaggtcaggggttcaagaccagcctgaccaacatggtgaaaccctgtctctactaaaaataccaaaattagccaggcgtggtggtgtgcagctgtaatcccagctactcaggaggctgaggcaggagaatcgcttgaacccaggaggcagaggttgcagtgagctgagattgcgccattgcactccagcctaggtgacagagtaagactccgtctcaaaaaaaaaaaaaaaaaaaaaaagacatatgacctattctgtcaaacacagtactaagtatgtaggtggtgaattacagataagcattagcatttccaggttgtatatgtcaaaggataggtttttactttatttccaaacatcactctgtatgtgattgcaaggacagaatttaaagtcctgttgaaacacagatgctgtgcagttagacagggcccgtcactagctgggagctacctcctgaccacgtagccttataacttttagagtgcaaattggtgcttaactctgcatttttccaatttgctgtagggaactggtgctgatcttgaaaacaatacagattattccttttatttatttatattttatttgtgcagatttatggggtacatgtgaaattttcttataagagtattccttttaaattgtgtttcagctgaattaatacacatcaaggattttttggtcactaaacttaaattctcaaatgctaagtgtctgttataagttctgagggagggtaataggtcaattcataaacatctaccaatagaaaattataaatgagcttttcagctgcctggggggctggtgctcactagttaatttgaataaaaagggagggaaatgaaggaggaaaagccaggttcaaagcaagaggtgcttcttcagggaggatctcttaacaaaaagaagtgctgaggccgggtgaggtgactcactcctgtaatcccagcactttgggaggccgaggcgggtggatcatctgaggtcaggagtttgagaccagcctgaccaacatggagaagccctgtctctactaaaaacacaaaattagctgggcgtggtggcgggcacctgtaatcccagctactcagcaggctgaggcaggaaaacacttcaaccccagaggtggaggttgcagtgagctgagatcgcaccattgcactccagcctgggagcaaaactcagtctcaaaaaaaaaaaaaaaaaaaaagggctgggccgagcacggtggctcaagtctgtaatcctagcactttgggaggccgaggcaggcagatcacttgaggtcaggaattcgagaccagcctggccaacatggtaaaacctcatctctaccaaaaatacaaaaattagctgggtgtggtggcaggcgcctgtaatcccagctactcgggaggccgaggcaggagaattgcttgaatctggcagatggtggttgtagtgagctgagatcgcgccattgcactccagcctgggcaacaagagtgaaactccgtttaaaaaaaaaaaaaaaagaagtggtggagaaattcccaaagttgtgtgtatgtatatgtatggaggtcggcggggccggggtagaagaagaaaataaggagaaaaaagttgaagaaaatccagaatttacaatttagccaaaggctggccctagccaagaccttttcttcagacctgattaatttgccccaaacctcaccagctctgagttctgtactcaaatgggggtgagaaagggaaagaaacctccagagtggacccatctggtgacagcggagagagtataacacgctctgcaggtggtgctggtgtgttgtgttttctctttgttccctcttctttctaaacccaggatctttcctttcctcctttcccattagaaaacatcaaaatgtcaaacctacaggcagttatatcattgtttcagctgcatgtgaatggactgatggcatcggccgtgcagctcattaaaataaagctgcactgtctctgatgtcttcacttgggtcatagagctgctcactgataggttgtttttctaggttttgaaaacttagctccatgttttctccccttcttaaatgaacctgttttctttacccatcccagatgaagcatttccttccattttgcatacagtctcccacatactcctttaggcaagcctctttattcacccctcctaactctcaccccttttagcaccagtttttcactttcattgaacaaggctgcagacatcctcaccccatgggaaggtggctgcctggacggcagtccacccagcctaacccacatgctgacagcagtgtcttccatctcaaacatttctgctttatacccttgccacctgttcagagcagatgggaagctgccacggcaaggccagtgctaaatgccactcatgcactctgcaaaccaaagcagggtttttgttgttgcattataataatggaacacaggctgcttgcagtcagcccctacaattgttttcatcaatcagttcctttcagtcagcccaggtagttgggatagatattgagaacaggtgcattccattgggtttccgagtgatttggtgcctgagctcctatctgcaatgagcacatgggaactgtgggtggtaggaggagtctgatggttgcagcatcagagtctgacgacgtggaaggcaactggtgctggcctaattccctgtggtacaacctgggctttggggccatcacgtctttataatcatttcgcctcatggccctttgccaagtttccttttaagcaatagtttggtctcatatgaccttactggagaatttaacaggggttcattagaagatgtagaagtatagaaataagaggggtttacactgaaaccacatggtattttatagagtgaggtattgtcaaatgagtagaacaatgcatattctttcgtttctatgttttgaaaaattctccccacagtatacactattgtgtcctaaataccatggcccctcaggtatttggccaaacaggctttcggattttggaagacatggagcatgaggtaagtgcctagatcctcaaaccacttgcctccacctatgcttccaggtggacactctggaggtgatacggcatccggaagaaaccaccaacatgaagaggcaaactgtggcttcttacttccgggtatggagtcttcttgatctctattctgcctgcttccaaaaaggactgtctaagccttcttatgagatgcccagatggagtcagtgaaacaagggcaaagcacagagtcaagaaagattgggttggggaagtggtggaagcaaggaaggaagagaacattgggcacaaaaccctgcccattaagtgactgattctgttagcatatgagctgcttcttggtcttaaagctactagaggcagccacttttctagcatactgaatagtaaagtagttaataaagttccagaaggtggcttataagttcagatactgagagaatctgtcttagcattgactttattttcctagattgaattgaccccttgtaaaacccacttgtctgagccctattatttcccatttctgccatccctatttctgatacttcatctagttaaatgcctcctttgggtaaaaacatggtctctagaagggctctgttaaatgcacattatatagcaaagataagacatatacactcttgcacagatttgtttgtcttcaaattataaagcgttagagttggaaggcccttagagactgggagctaaggtccagatagtttcacaatagaaatactgttaggccgagcacattggctcacacctatagtcccagcattttgggaggctgaggcaggcgcatcacctgaggtcaagagttaagagaccagcctggccaacatggtgaaaccccttctctagtaaaaatgcaaaaattaggtgtggtggcaggtgcctgtaatcccagctacttgggaggctgaggcaggagaatcacctgaacctgggaggtggaggttgcagtgagctgagattgcgccattgcaggcctgggtgacaaagtgagactccctctcaaaaaaaaaaaaaaaaaaaaaatgctgttagatcaaatttagaactgatctcagggatagcagaatgaggtagtaagatagggttggcacaagaaagggcttggcagggatgagaggtcaggtggatgggaagctggaagagccaggaaggctgaagggcaggacttgggagccagcactctggatagaaggctccatggaaagctagcaggtgcagggatctaaaacgcggaagtccagcctagccaattgtgcttcagaggcaggctagaattgggctcggtatgaattgcaggggccccagaccttcgaatccagtattccatccatgcattgagtcgtgctatagcatctgtggaaggtgggcccctgcctcatcattctgatgtttggttatttataattgctacttatttcttatattgagacacacctggtcctatccccttgagtggctctatcctcatctgttagtctgttagtccattttatgttgctatgaaggaatacttgagactggataatttttttttttcttttaagacagagtctggctctgtcacccaggctggagttcagtggtgccatctaggttcactgcaacctccgcctcctgggttcaagcgattctcctgcgtcagcctcccacgtagctgggactacaggtacgtgccaccatgcctggcaattttttttttttgtattttcactagagatgaggcttcaccatgttggccagtccggtctcgaactcctgaccttaggtaatccacccacctcggcctcccaaagtgctagggttacaggcatgagccactgtgcccagccaagactggataatttataaagaaaagaggtttattggctcacggttctgcaggctccacaagcctggcaccagcatctacttggcttctggtgaggcctcggggagcttttactcatagagcaggcgtgttacatggcaagagagggaggaatggagagagaacaagatagaggggagatcccagactcttttaaacaacccgattttgcatgaactaatagagtaagaattcactcattgccgtgaggacagcaccaagccattcatgaggaatttgccccatgacccaaacacctcccactgggcccatttccaacattagaggtcacatttcaacatgagatttggaggaaacacacatccaaaccatatcatcctcctggtaacccttggtgtctgtatgtgtttcccactggatttagtagctctatttactctgtgaagtgatcctcaagatcttagggcccccctatcagcagaaaagcctctggctacggtttttcagaaatatacccatacaaccagtttggtgttctcaaaatacccgttcacgagtgctaaacctgaaaaataagttaccttggaaactaggtaacaccaattttgatctgtaggagcagtgactatgaaataatggaactgagttcctttggcttataatagctcctgaaggtgagcccagaagagctccagcagtggatgcccctgaggaacaactgaggccctccctcacaagcacccccctgattttccgtgtccttgctcccctcttgctgtgagagccctgtaccagctgcttggtgtatgttagttgatagtcaccacagtcttctttttggtacttctctcattttctttgccttgtttttgtatttttcttttctgtcccactaccttattaccaatcgtatctgtaggatttgcttagactatctggtggttcttaggctgaagaagcaaatagccccttcctcaaaagctggacattttaaattacagatacagattgtggaacatcaccttggaataccagcgacaagcattctagttctggcggtggaattacaggataacctagatagagcatgttcttagctaagtttctgccatatgggatattgcttggcactaggtgatgtttaaagaatggttttgaatctgcagatggctataagtgcaacttacattattatctcctattgctgatttcatgttcttcctcaagaaggtctgtgagcctcgaactgctccagaggcttctgcgggcctgtgttgtaactatccattgtgttggtggtaaccttgttccttgtgcatttttctccctggtagtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtcagaccgtcatctacgggaatgcattcttataaatgtagctctactctggccatccctgtgtcctaagattgttcctcctgcgtgctctcctccaaacatgtaattggctagttgccagctaccatttacttgcttgaatgttgcatttttattgtgcttcaactaaactgcagtgatccagcagccagattaagcttccttctgatcacattattttaaatttccatatacgtttatatgttataaatccttaggtctcaagttctccaggtattttgttgttatgatgaaagtatccctccataagtgggccggatttgaatgcacccaagcaccagttcttcttccaggttctggcatgatataatacgataattaacacttacataacacctgaagtatcataagagtacaggacattttagggcactattctaaaatgtattatctcatttgatccatagaacaaccctataagctagactctattatcatccccattttacaaaacgtaaaggtgagaaaacttgggtatgaaaagaaagtaagtgattttcccatggtctcatgctggtcaatgtagaaccaggatttgaacccaggcagtctggtttcagcatgcatgcttttaatctcttcagttcagtgcattcaatcaatatttattgaaataaattgcatggcactttcttaacccagaaagtgcctttgcctaagaatgaaatgctgctcttttctgaacgactgccatagagattatgtatgaatgtgattacaagtagaattttctgtgaagaaataaggaaaacagtaacaaaaaaaaaacacccctgagaagcactgctgtctgaggatgcctggagaggaatattgaaatccattgtatgcctgacaaagacaaggcaatcaagaaaaaaaaaatacattgtagaatctgcctcactccttaagccatccttagtgtctttttacttccactctgaaacatgtgcccaaagtcattttttccaaaattttctcaggagaggatgagtcataaatatggtagcttgctttgtcacgtctcccaaactctgctaaattccatggaaaagataaggcaaaaaaaaaaaaaaaagttccttgcaatgagagcttttaaattaaaaataagaaggaaatggctttttttttttaagtgtctttgagctccttttttcctcttaaatttggaagtggaacaagaaaaaaaatttagcacatgaatttgactagtcaagtattttttgtaacaatgtttgaatacataaaaatatttaagaaaacaggtcaaatgctgaacagattggcacttctttgttcataatcagaaagccattaggcaagtatgaacaggagtttcaaaatgccagtaaatctgaggatatcaaagatttctgagccagcaagttaattggtattttgatccttttgaaccacttaacaaaatggatgagttagcagttttctcccttgatgttattcaacaaataggtacacttcttatcttcctgttcaagagtgctgttttgtaaactcttagcaggaaatatgcagacaggacaatcaaagacaggaaacagagccattcaaggtttattaaatggaggtaaataaaagataaaaactcatttaatgtgactctacatttttgtattttctggcattcaggactgaaaccctgagtatacacctggtggtgttcttgggatcatgttgttgggttccagaaaggggaaagacttccccagttcccaaattacccaagtctgcaggcttggccaagcctaaaatactttcttgcccctattatctttgagctttctggcaaaatgacttggaagtgcccttccttatcctctactcatggagcctttgaggaagagggtgtccccaacatcctctcatcaatagggccaggtgaattggaagtctttatgttctcgactaggcatgaaagaggccacctggaaatgctggagccacactgttgagggacgtcatagaaaagcaatctaagcatttattgtttttatggtcagtggattctgatgcatagtctctcagaatgtctacagagggcaaacacataactgcatgtattgggatgtgttctggcaaatgtctaaaacatagggctgagtcaggctgggcgtgatggctcacacctgtaatcctagcactttgggaggcaggcacatcacctgaggttaggagttcgagaccagcctggccaacatggtgaaatcctgtctttactaaaaatacaaaaattagctgggtgtggtggctacttgggaggctgagccaggagaatcgcttgaacccaggaggcggaggttgcagtgagccaagatcgtgccactgcgctccagccagggcgacggagtgagacttcctctcaaaaagataaagaatagggctgagtctaattgtttgtttatgaagctattgtagtaaataatgcagtttagtaaggagacctgaattctagtctccttcagtatataacatctggaaagtaacccaatattctgtaaaagatgtttcctcacctgcatgacaagaaggcaggaatatacaaagcccacattctaaagattttcaaggattacttgcagatgcctggggcttacttagtttctaagtcttctagggatttttgccttcccagtcgagctcgctggatgagagacctgcatctaccaggctgtgatgcgtaacagttgttaaccattgaacaaaatgaaactcttccctcttctctttcattggcatcttccatttcttctcatgatggcgtggagaaccatggtgtcttggtatctctttcatctcattctcctttctgttccttcactctctctcttccagaaactaggagtcacctttgacttctcctcacttcctttaaataatccatcaccaggtccagctcactacctgctaaagtttctaaaaaatgttcccttgggaatctctcatcccttctcccatagctttagtccagcccttttgttattattaacagctcaatttagatataattcacgtatgataaaagtcatcttttgaaagtatacaattcagccgggcacggtggctcacacctgtaatcccagcactttgggaggctgaggagggtggatcacctgaggtcgggagttcgagaccagcctgaccaacatggagaaacctcgtctctactaaaaatacaaaattagctgggtgtgttggtgcatgcctgtaatcccagctactgagcaggctgaggcaggagaatcacttgaaactgggaggtgaaggttgtagtgagccgagatcgtgccattgccctccagcctgggcaacaagagcgaaactccgtctcaaaaaaaaaaaaaaaaaaaaaaaaaaaagaaggaaagtatacagttcaaaggtttttaattagtcacagagttgtataaacatgactaccatctaatcatagaacatttcattacctaaaaggaaactccaaactcattagccattctcccttttctcctcaatcccaccaaacttaggcaaccaataatctaacttccatctgtatggatttgcctatttttgacatttcgtgtaaatggaatcatacaacgtggccttttgtgtctggcttcttttacttagcatgttttcagtgttggatgaaatgaatactggtactatgtaccagtatgttatttttttgtagatgaataatatcccattgcatgaatatatcatgttttgcttgctcatttatcaggggatgaacttttgcattgtttccactttttggctgttatgaataatgctgctatgaatattcatgtacaacttttaatgtggacatatgttttcacttcttttgggtatatacctacgagtagaatttcttggtcatatggtaaccctctgttccaagtggctgaacaatttaaattaccatcaccagtgttatgagagtcccaatttttccacatcgtctccaacatttattattgtttgtcttttttattttagtcattctagttgatgtgaagtggcatctcattgtagttttgatttgcatttctctaatgactaatgatgttgagcagcttttctgtgtttcttggttatgtgtataccttctttggagaaatgtttattcaaatcctttgcccactttatattgttgatgtttatgtattccaaatattagtcccttatcacatagataatttgcaaatattttctctctctctctctcttttttttttaatgagctactggtcactttgatattttctcactctatgggttgttttctcttttttttttcttctttgagatggagtctcattctgtcacccaggctggagtgccctggcacagtcttggctcactgcaaactccgcctcccgggttcaagcaatctcatgcctcagcctccggagtagctgggattacaggcatctgccaccatgccctgctaatttttgtatttttaatagagatggggtttcaccatgttggtcagggtggtctcgaactcctgacctcatgtcatccacccacctcagcctcccaaagtgctaggattacaggagtgacccactgtgcctggcctgggttgtcttcttgatggtgtcctttgaagcacaaaattttttaattttgatgaagttcaatttatgtatgttttcttttgttgctcgtacttttggtattctacctaagaagctatcatctaatccaatgtgacaaagatttactcctatcattattctgggagttttgtagttttacctcttatattttagatctatggtccatttggatttaattttttgtatggtgtaaggtagaagtctaacatcattcttttgtatgcggatatccagcagtttcaacaccattttgttgaaaatactgttatttcctcccattgaattgtccttggattcttgttgaaaatcacttgaccaggccggggcgcagtggctcacacctgtaatcccagcactttgggaggctgaggcgggtggatcacctgaggttaggagttcgagaccagcctgattaacgtggagaaaccccgtctctactaaaaatacaaaattagctgggcatggtggcacatgcctgtaatcccaactacttgggaggcggaggcaggagaattgcttgaacccggaaggcagaggttgtggtgagccgagatcgcgccattgcactccagcctgggcaacaagagtgaaactctgtctaaaaaaaaaaaaaaaaactcacttgaccaacttgaccataaatttaagggtttatttctggactctcttctattcttttctctatatcttttctgggccttttaaaacgttttttttgctcaccctcttgccagttttctaagtggacttcctgcctatttcattctccaaagagacagcagaatagaatttgttaaaattcctatctgagcatattgtttccttgattaaaatgaccatccaggcccccatggggtgagctgcagtgctctggcctggtgtaagggagtccacctgatttggcccctgcttactttcctagtctcttctctcattttccacatctcagatcacactccagccaaaattgaattacttggtgttccctaaccatcccaggctgttctagtcttttgtgctttgctcaggctatgtcgactaaatctgccttctccaagccctcagtctgctgtcttagccaagctaaatcctactcattccttaggtctttgaccaggcattaacttttctgtgataccctccttgactttcccaggctgagttaggatctcttttgatgagcttctttggtagcacttactacattgtagagcaattatctacctcttatctgaaccttaactgcctggaaggcagggatatttttcagctcactttttatctatttatttatttatttatttatttatttatttatttatttattttgagacagggtctcactctgtcacccaggctggaatgcagtggcacaatgttggctcactgcaacctctacccgctgggttcaagcgaccctcccaccttagcctcccaagtagctgggccacaggcgtgcaccaccatgcctggcttatttttgtatttttagtagcgatgaggtctcaccatgttgcccaggctggttttgaactcctgagctcgagcaatctgtctgcctcagcctcgcaaactggtgggattataggtgtgagccaccatgcctgaacttcagctcactttatgtctgtattgtccgatgcagtgcctggcacgaattcagtgtttaattaatatttgttgagttgaatcaaactcttacctcttctttttcatcactattttctttttctttttctttttcttttctttttttttttttttttttttgagatggagtctcactctgtcacctaggctggagtgtagtggggtgatctcggcttactgcaagcttcgcctcctggattcatgccattctcctatctcagcctcccgagtagctgggactacaggcacctaccaccatgcccagctaatttttttgtattttttttagtagagacggggtttcaccatgttagccaggatggtctcgatctcctgaccttgtgatccgcctgcctcggcctcccaaagtactgggattacaggcgtgagccactgcgcccagccgttttatcactattttcttttatcatcccttgactcacacttcgatccttgctctttgaaatatatgacagatacctagaactggctttgttgaggttaagttttccttgtactgtagtgtacaacctagattgatagaatgtaagatttcaggtaagtcatagtagctctttatcaataaaaggtaagaaacctaaataagttgatttaaaataaggctgtaacccagtttgacaatgctattattagaagttaatacattgaaaggctaactttaaacaaatttgcctcccttctctataacaaaaatgattttttttcgaaatccaaagagataagcttaataggacaaggaagactctctcgttttccagcttcttctctctcatctccccatctctcagctcgtactccagaaaaaaagaaaccacttggagcttcctaacacagcctacgtacattttatgaaagcaccattctgtgaaagcaggctgcttacttggtatgttagttaggaacctctcaataacaagtaactgaaactcaaactagttgaagcaacaattaaaaggggatgacatattggcttaggaaattaggaaatccaaagacatgtctggatccaggcaatcaaacagttttaccaagccagtgtctttttccttgtatcaggtttctttttcccttttttgagtttctgataaggagccaggttagctctccttacatgttggcaaagatggtccctggatgctcctatagaaagcattctataggcttagcaacattagcagcaagagagtttctgagagttcttatgcaaggaactctctgactctctgagcctggatcacatgcccacccttgagccaattactgtgcccaggggtatgattggcagggtcttgggtcaactgccagggatggagtcaaccccacttgaaccatggcctaatggactctttaaaggaaggatagggatggataggctaaaacgataggcatccatggctggacatggtggctgacgcctgtaatcccagcactttgggaggccaaggtgggtggatcacctgaggtcgggagttgaagaccagcctgaccaacatggagaaaccctgtctctacttaaaaaaaaaaaataataataagccaggcgtggtggcgcatgcctgtaatcccagctacttgggaggttgaggcaggagaatcacttgaacctgggaggtggagattgcggtgagccgagatcaccccattgcactccagcctgggtgacaagagtgaaactccgtctcaaaaaaaaaaaaaaaaaaaaaaaaaaaaaaaaaaaaaaaaagataggcatccattacccttagttttgactattctgtgtcctagaataaatgacaacagttcagaaaggttcaccttagcccagatatctacctataggagccctttaatttagaatttcgtaggaacaaaaattttgctgacaataactgaatgttaactttggaataagaactaaatatatatagttactatcgttttcacttaagaatggtcatcttgttttgtttaaacacgacttcacatagcatacagtgggttattgaaaatagtttccagctccacttcactaagggattagagaaaactcagtctattctggcccagtttgaatttatcttcttgcatttgacacagttctctgactctctcacccatgatgttcttgtcccacctaggacccagcatagaagtgctgcatgtcactatgtcacttccctttcgcagggtctcttctcttagcctctatttgtgttttgtttgttgagatagggccctgctctgctgcctaggctggagtgcagtggcatgatcatggttcactgcagctttgaactcctgagctcaagcaattctcctgcctcagcctacaagcaaccgaagactacatgtgcaaaccaccatgcctggctaattttttaattttttgtagggacaatatctcattatgttgcctaagctggtctcagactcctgggctcaagctatctatcctcccaccttggcctcccaaagtgctgggattacaggtgtgagccaccacgtccagcttattctctccttttgagtatttcctgccatactttcagaatactaatcaatctttcagctgaatttttgcttacactttgtgccttgctaactctagtctctgtttaccttacatgatcctttatactgccaccagaattacgtttataaaaatatcaagatgatcatgtcactctcaggaataaacttctgtgcctcttcttcgttgtctatgggacgaggtctaaagcctttagctcagcaaagtgaggaggcaaagcaattccatcttggacattaacttgccatgttaacttctgcttaaccccagttccagcaattcctctaagatttttattttatttactgtttcttctgcaagagcatctacttaccataaatcctgcccttaggtaagaacaaccttgaccataaatcctgcccttaggcagatttacacagcattcttgcttttccctgggaggttaactttgattatcctacacattcctttccttttgaaatgggagtgttccctgtccccccccacaggacatgcgacaagggtgtggctcgtctgtttggtcaccaccactgctgaaaccacctgcgggaaggggagcacgtggatggacacgtgcaggagctgggacaagcgctgtgggttccagccccactctccaagtagtgtctaggagtggggtgtctgcaactcccaaagcccaagtgggcatgttacagtgcactctttcagctttgctgtccgcagatggcttaagtgttaaaccagctcagtggaccctctgccttttcccaagggtagtgggccagtgtgatagctttctgtatcccaagctcttgtcttgcgccccagaagaatcaggtcatacatgggcttgaaggatgaatgcaggggttttattgagtggtggaagtggctctcagtgggatggatggagagctggaatggggatggaatgggaagatgatcttcctctggagtttggctgtccagtggccagactcctctccaactgcccctagcagaactcctctcagccttcagatactccttctattctctttctctgccatgctgttgtgccatgctctgcttgtcttctcatctgctctggagcctggggttcgtggtttgtatgggtgcaaaataggggatgtggtgggcccaaaggcaattttttgggtgcaaaaacaggaatacctgtccttatttagggccatgggtattcagacttgagggtgggaccattgccggggaaccatcctcttctaccgagtatttccctgtcttctgttcatatcactttcctatggtatataagcactgggttgggggttaatggcccagggatcctccatcttgtcccactgccatcctagacacagacatggcttttgttcataaatctctattaaatgtttctttctttctaaggaaccggatatgtcagcctctttctttggactctcagcttccttagacttttgggggtaggtttgcctaggcctgcctactgcagaacacaaagctttccataactggtctcaactgaccattctcatttttccccaccattctccctcacatagcctagactgctgtcagcctgaccttgggccctccagccccatgtgtgatggtcagcctttgtgcattctcttcactgatggaaagcctcttcctctggtggttttctcttcatctttcaatccccagtccaggcaccttctctatgaaggctgcctggactctgccaaactagttgttgctccatcctctgtgctcccacaactggatgttgatatctctgtattagaacctatagtcttatttttatcctaacatgtctgtctgccccacaagactgtgaacttttacagggatggagtggactttactcatttttttatccctagcacttcacgtgttatggtatctggctcatggtgtgtgtccagtgtttcctgaatggaggactctattaatcaggaatacatttgactgtgaatagcaaataaacattcttagtggcttaagccagagtttctcaacctctgtgttattgacattttggaccagataattctttgttgcgagctgtcctgtgccttataagatgtttagtagcttctttctagattctacatactagattccaacacctccaccctcagcagttgtgacagtcaaaagtatctctagatgttgtcaaatgtctcctgagggggaggcggggaattacccaagatgagaaccactggtgaataggtttgtttatttcttctcacataaaaaagaagttgagaggtaagctgtttctagcattagttcagctgttcagcgatgtcatcagagacctggacaccttctgaccttctttcatcccttttggccggctttagtgtgtgggttggcttatagtgtcacagtcacaagatggctattgccccttcaactatcatgtctgcatttaaggcaggaaaaaaggagcaggatgaatggctaaggcagccacgtctctactattttttatcaggaaagaaaaaattttttcagaagccattttacatatacctcattgacctgacctgggtcccgtgaccattcctagcttcagggagaggcttagaaagtggagaacaggactggggcacattgtcacccagtaaaaaactggtgttcatttagccagggagaagtgagtgtggaaatgggggaggcggttagtcatgtttctctcagagaagaaatctaatatttattaattgaatgcgggagtgatttaaagaatacgggatgaatgaatattaagtaaatatttcgagttccttacaatccattcatttcttactccttgctacctcatttaagagtcagaaagtgcagacgtgcctgactagaagcaggtgagatcctgggaattttctaattccgtggccatggagaaggtgtgtggggtgttattgtacacacacacacacacacacacacacacacacacacacaggtttttttgtgtttttttttttttgagatggagtctcactctgtcacccaggctggagtacagtaatgcgatctcagctcactacaacctccgcctcccaggttcaagtgattctcctgcctcagcctccgtaagtagctgggactacagccaagcgccactacacccagctaattttttgtatttttagtagagatggggtttcaccatgttggccaggctgatctcgaactcctgacctcaggtgatctcggaggtcttggcctcccaaaatgttgagattacagatgtaagccaccatgcctggcccatatataggttttacatacacacacacacacacacacacacacacacacacactaaacctatatatatataataggtgttattatatatgtatatatattttaaaaacctatatacaaatatatattatggctgagcatggtggctcattcctgtaatcccaacactttgggaggccgaggcgggtggatcacctgaagtcaggagttcaagactagcctggccaacatggtaaaaccctgtctctactaaaactacgaaaattagctgggcatggtggcacatgcctgtaatctcagctactcgggaggctgaggcaggagaattgcttgaacccgggaagcggaggttgcagtgagccaagatcatgccactgcactccagcctgggcaacagagtgagactctgtctcaaaaaaataaaaaataaataaaaaattaaaatataaatattatatgtatgtgtgtatgtatataaaacctatatatttatatataaaaataatatatagaatataattatattatatatctattatatagatgtgtgtatatgtatttaaaatatataaaatatagattttatatatatacacacacatatattttaaaaacctatatataaatatatgttttatatatatacatctatataatagaggtgtattttatatatattttatataaatgtatgttttatatatacatacatctatataataaaggtgtattttatatctattatatataaatatataggttttatatatacatatatataacagatgttacatatacactacatatataaacatataggtattatatatacacatatataacacctattatatataggtttaatatatatacccacatatgtgtatatgttgtaactgaatgttaactttgtaataagaactaaatatattagtatacatatacacatatataggtttaatatatacgtatatatgcatatataggtgtatatgtgtgtatatatatgcacacatatttataggtttaacatattttataggtttaatatgtgtgtatatatattaaacctataaaaccatatatgtgtatatatgtatatgtatatatattaaacctatatatatgtgtgtatgtatatatattaaacctatatatatgtgtgtgtgtgtatatatatatatatataaaataacaccacacacatatatttgtttatttatagacagagaggttttcagcatggttcctggctcataactcccataacccttattacagtcttttgtttataatgtttggtgtgtcaggcctcaggaaacagaatccttctgccctcctttcacgggccccaaggcaagactttaatcttcccctttctgattgtgggtcataagaccctccccagagagggtcccatcatatatcacagggggaggaatgctgaagtcatgaagcttcagtgataacccaagaggtttggattctggatagttgaacacatggaggttcctggagggtggcacacccaagcaaggcatggaagctctgcaccctttccccggtaacttgccctactcatctcttcatctgtatcctttgcagtatcctttataatgaactggtaaaagtaagtgtttccctgagttctaagagctgctccagcaaattaattgaactcaaagagggtgtcatgggaaccccaacttgaagctggtcagtgagaagtttcaaaggcccagacttgtgactggcattgcggggtggggagtggttagtcttggggactgagccctcaaccagtgggatctgacactatctccaggtggacaatgtccaaattgatttgaaggatgcccagttggtatctgctgcagaattaactgcttgcttgtggtggggaaaaactcacacacatttggtcatagaagtcttagtgttgatgattgttgtagtggtgtgagagcaaaggaaaaacatcatttgagagtttttcccacaacagtgtgtttgcagttttaagcctacaacacatcctttaactctcgcaaagtgaactgaatatcatcagttaacattgtgaaaagttcacctatgaggacatggtccaccatattcccttattaagccctaaggttagtgcctactcacaggatagcgtttagagaaatcagcagcacagaagaacccagacatctcgagaaaggctgaatgtcaaacttcaattttcaatgagtaaaagcttctgcttttttctctgggtagacaacagtgaataaggaataagaaaacacaaatcctccaggacatcattagacttcttttcttttcacctgtagctacatagatgagagtctgatataaacagatcttaatgtgtcatccaggtaagctagtacatctgcagcaaagtgaacagcatcctcaataccctggaaattgctgggtgcagtggctcgcgcctgtaaccccaggaggccaaggtgggtggatcacttgagcccagtcattcgagacctgccttggcaacttggcaaaaccctaaaatacaaaaatgagcagagtgtggtctggcacatgcctgtggtcctagctacttggtagctgaggtgagaggatcgcttgagcctcagaggtcaaggctgcagtgagctgtgattgtgccactgcactccagcctgggtgacagagtgagatgtttcaaaaaaaaatttaaaaatttttaaaaagtaaagaagaatattccatgaaaattaacttacatggtgtaaggaacctgttaagacataattagggaggatgacagcttcaacattgtgagtaaaatatatttcatgcttgtatgaagtctccacatctaccttctaggggcaggagtggcatggtggcttctctgggagggtctttaacattgctctccttgcatactatcgtttccatcagcttttctttgtttagttgagagggtgagttgctacctgcttcccaactgtgtgtgttggtgccttttaggtagtttatgtattagagtattagggaggtgaaactttgaatgacttcttttctctcttaatccttacattacgaatgttataaccttggtgatatggtttggctgtgtcctcacccaagtctcatcttgaattcccatgtgttgtgggaggaatgcaatgggaggtaattgaatcatgggggcacatctttcccttgttgttgtagtgatagtgaataagtctcaggagatctgatggttttaaaaaggggagttttcctgcacaagttctctctcttttttttttttttgagacagggtctcactctgtcacccaggctggagtgcagcggagcaatctctgctcactgcaacctctccctccagattcaagtgattctcctgcctcagcctctcgagtagctgggattacaggtgcgcaccaccatgcctaactaatttttgtgtttttagtagagacggggtttcaccatgttggccaggctggtcttgaactcctgacttcaggtgatctgcctgccttggcctcccagagtgctgggattacaggcatgagccacagtgcccggcccaagctctctctttgcctgccgccatccacgtaaaatgtgacttgctcctccttgccttctgccatgattctgaggcctccccagccatgtggaactgtaagttcaattaaacctctttcttttgtaaattgcccagtctcaggtatgtctttatcagcaatgtgaaaacaaactaatacacttggttagtgcagtaaacaaaaaactttcttaaaatgccttttacaatatcactgaaagactctaagagatggcttgatccaactttctcatttacagatctgtatttacagatcttatttacagagtctgaggcaatagaggtaaaatcacttccccaaggtatctctaggaataggcaatatcagtctttccagaatattataggctaaagagaacttctgtgaccacctctacttattcttatggggcaggatgggttcaaattggcattgtgggctgaggaccctttcttagttgcctaaggcaattgggacaaaatcccaaaactaattgttttaagccctgcctttttcatggagcccatgctgctggcagcagcttttcacatagtcaattagaaaaatcatttctgtagttgatagctctgtagatttagccaggaatctgtagtggtggtttgaaaaagtggatgcaagaattaatattcatttcactgttctccaaaacactgaatggtggcagaataataagcccaggctatcttttctgattttccaaatgttctgtgttataagcaacctcatgaattagttcagttgtaggaaagaagaaataataaaggaaaacaagagaaaagacattatgaaggcattaaataatatctggacatttggatttgcttgcccagcttactctggaaatcagtggctgaattaaaactccttgcttggggattctttttttttttttttttttttttttttttgagacggagtctagctctgtcgcccaggctggagtgcagtggcgcgatctcggctcactgcaagctccgcctcccgggttcacgccattctcctgcctcagcctcccgaatagctgggactacaggcgcccgctaccacgcccggctaattttttgtatttttagtagagacggggtttcaccgtgttagccaggatggtctcgatctcctgacctcgtgatccgcctgcctcggcctcccaaggattctttaaaacaaatatcagtggggctaacttatgttagataataacaatgaagcagcaaaaagaaaaagcaatgaagaaaataacaaaatggagaaaaagaggaaagagaatgtgaggaaacctcctggcatggggatggcaaatacatgggtatgagcacagcttcactcttcaaccctagctgcagacctggctcttcagtcaaggcatgttttcttcacagcctcgatgtggccttggaatccctcccaacatggtgctctaggagaacactacccagtccatcagctgagcagttgtcctcttagccgtgactggtacagcatgctctagttacttacagtaaatatctgcctacccctgagcacgatggtttagggatgacttacagaaaagattgctaactatgtttcttcacatgtttgggtaggagaagagaaaaatagatttttcttaaagggaagaagagagagatggacatttattgagaacctactgatggtgggcttcatgctagggttttacgtatatcatctcacttaacactggtagtagtcccccagatagatggtatttattctggttttacaaatgaggaaactagctcaaagttacacagagagtatgtggatgatggagtcaggatgtgaaatgcccatcctcaaaataaataaattgaggtggttgaacacatctgaatattcattgtgaaatcaatctgtagagttcaatcagaaaaaaatgcattaataaattttctaattgtaaataatcagtttaaacttaagcttttattacaaattaatttgagtaaatccagcctcaatttccaattcccagtgtcattgtgatttttcctctttaggggcctctcatttaaagtttatgaggaggcagcagtagcagtatcagaaacatttattaagcacctgttgtatgctaagtgctatctatagtgagtaatactgcattagaaggaatctataatttcaggactttttctttctaatagcacagattagtgcaatttcttaacccaaggcccaaatttaggagtctaaggatataatgaatatatggcttttttttaggcagcagatggtggccagctgttctgtctctttactcaaggccaaacatgaagggaaaaaattaaagtaacagggattatggtaaatataagatagaacttaatctaaatctgaatttttatacacacaaaggggaatgggcaattgggggtaattatcagattatccaagccaaaatagttctgctacctccattatctacataagagaaaattatttatatggattgaattgttcagataattgtctagtattttgggtttctgagtagacagtctgggtggtcattgatatacattgagggtccttcaaggaatattttaaaatgggaaaagcgtttatttctttgccatatgactgggggcgtttctacttagatgcaagtaatattgatcaaatttgtatagtcacgattctttgaccaggatttgggcccattacaataaaaccataacaatttttacccaatgtttgaagtcaatttttaattgtaaaaataatgtatgaacaccctttcctctaaaatttttaagtatcacatataaagctaaaatttcttttccatatccctaattccatttcccagcatctgcccaatgatgccccctctctaaagtagctttagtagttttatcctttcagaacacacacacacacacacacacacacacacacacagagagagagagagagagagagagcgagtgagttagaggaagaggaatttggactttagcttgtgaaccacactttttataccatttgccaactgcttttctacttatacatgttagagataaaaccatgttgttccatagctctaacaaaattcctttcaaccccctcattgacattcatgatatttatttagccgttcctctactggtggatactaagattatttccagttgtttgctagcagtgctcaataaacaatcctaaatattaaacatgtgtgaggatttctttaggggagattctgagcagttgaccttttccaagagaaaatgatgtgctccagagactccgtaagtcatttgggcctaacaaagagaaaagatgatggagatacttgggagccagtttctttgcttatataaactctgtcactggaaacaagtcacttaatttccctgggattctatttctgtaaatcactgattctccaaccttctcacacaacagaagctcctggaaggctagctaaaatgcagattggtgggcctcatccccagagtttctgattcagtgagaaagaaagagggagagagagagagagagaagagagaatttgcatttctaataagtttccaggtcatgctgcagctgctgatgaggacactacactgacagccactgttctaggtgtatgttggggagactatcctgtggaagagatcatagttgaggttttaaagcccctaatagattatctagggatattttaggaggcttccaacttattatccaaacataagacaataactcaagatttatcacagtaacagtatcagatcaatgataaacatctattttaaaaatcacagaatccattcttttttttttttttttttttttgagatgtagtttcgctcttgttgcccaggctggagtgcaatggcgcaatcttggctcaccacaacctccacctcccaggttcaagcaattctcttgcctcagcctcccaagtagctgggattacaggcatacaccaccacgcctgactaattttgtatttttagtagagacggggtttctccatgttgaggctggtctcgaactcctgacctcaggtgatccgcccgcctcggcctcccagagtgctgggattacaggcgtgagccaccgtgcctggcttagaatccattctttttaaccaagagagaagtcaacctagaatctttgttagaaggaatcttgaagggtcatccagtccaactacctggctaggctttcatcagtagcattcttgacctcatcaactagcgtcccattgaatagattcagtgtttatgaattcactccccagctcctgaagtagcccattccctgtgtcgagatgtctgatcaccatcatgtccttcataaccctgaccataggaaaccatccttcagaagcttctaagcatctaccccggttctaccctcaaggctttactgaacaaatcatttcccttctccacttgatggcagtcaattatcatgttcccctaagtcaatggttctcaaactttagtactcaatatcactgtaggagtttattaaaatatagactcccaaggtccagccccagagattctgattctatgtctggagtgtggcccaggaatccacatctttcattgtatctccaggtgattctgatgcaggtggtctgcacatgactgtttcagagaccctgctaagtctttttgtttttaagctccacgttcccagcctcttcatcagtttctcatacgacatggcttgagtttcatcactatcttggttgcttaaggctgcctgccaaaatatacccctaaagtatactcattgaccttcccacactgattttttattcttatccttatccaaaatgatgtccttcatatttctgtttatgtttgtcttccctactagaatataaagcttcatgagggcagggaaattgtgtgctttgcttactcgtgtcattcagcacttctgcccatgcctgatacatcagtagatcctacgtcaagttttatttaatggagatgaaaaaccaatttgatttacaaagtggtgaatggtgacaacatggttataccaaagccctaaaactctacagagtgaatgatccattctaaaagaaggaatttgtttaaagtctttataaataaaaaaatgtttcagtctgtgtaattagccttgagataaattttcacattgacttagggctgtgcagatctccaagccgggtgcagatgttttatatgcctttgagtgcaaaactcaattggagggatgaatcaaagcagagctcattcattctaggttaggatttcaaagccatctttaaaacatacaaatccttccccagtgtaaaaatgcaggagcagaatgaccaaaatgagaggtgcaaataaaaaatgtaggccatctcccacgctaatacaatttttatctaaaatggtgattcttctttctcctctcccttccatgagtaagagtaaccaaggggaaaaaaatagagaaataaaattcattgttcattgtgagagaacatcattgaaaacaaaaggaaaaatccagcctctttaatcaaggaaattcaaattaaaaccacaattcaacaccatgttatgcctattttggcagtaaccaataagtctgttaattccatagagtgtcatagttagagagcaatgggactctcatattctagtggtaaggatgtaaattagtgtaatctctttgggaaatagtttgactttcttgataaagtccaacatgaacatattccacgaatattttccacttcaaagattataagtagaaaagtagcagtggttttatttatttatttatttattttattcatttattttttttagcctactaggtaggccttttaggattgcttggtagcattgggtctacccaggtatgaagactgcctacctcaaaagttgcccatttgtgtgtgtgcctttgtgtcaaacctggatctatagcgtagatttttgtacttctttctttcccttgttaaaaaaaaatgttcagaagaagataaaatcatgactggcatacagaaataaagatgaatgtgttaaaaagaatttattttattcatacgttatgagggaactaggcagatgttataatcagttcaaaggaagagtcaaagtagcatagcttatatgaaataaaagaatgttgggatgaattgcaaatggaaataaaactggttttctgcagtgggtaggaagtcaattagaatcattatcaggctggacagaatttacatatctatttatcagttggaatttagaaagagttgcaaaatggctcaaaggggataacaggactctaataatctgataactcaggaagttattttaaagacaatgtatatagctttctactgaaacagaagcaccttcctgatacactaatccaaatagaatattctttggatccctcacacgtatgtcaaggagagccagactgctggtactcagatagaagaaatcaacactttaagtcaaaagcctgatattccagatacctgtaaacactcatgagttccaatgaggtgaaaggtgctggagcatcagaagtgcctgccagagtgtcaaagataccaggtgcacacaggaagagctaggaaggtttgataagtgtaaagaagcctgaattagaagacctggtaagcctcagatcttctacttactaaatttctcaccttgggccaattgccttctctctggctttctcctctgtacaaagaaagagttttttatcaatgattttaagttccccctcaggatctaatgtttactaaaggagccagccagtcccttgcagagacagccctgtgggaatgcccaggcatagagttttgacgcagggcagggaagatctgtttgtgaatgtgaggaggaacaatgggattggggtgtcctagatccccagtgtgcggtgcagaagcccccaaatctgtggggaacttgggtagtcagtgaacaaagagaagagaaatgatagggaaggaagtcactaaaaacaaccttctaccatttatggttttgcacagaacttatctctacctttagcaatattgtaagtttatcaccaaggttggctctgtctccacagtttacctacatgagagcaatcagggttctccagagaaacaaaaccagtaggggtgtgtgtgtgtgtgtgtgtgtgtgtgtgtgtgtctgggtaagtgtgggtaagtgtgggtaagtgtgtgtggtgtgtagactcagtacagtctagagacagaatccctttcttcctcgtcacgggacttcaatcttttaaggccttcaactaattttatgaggtccacccacattatagagggtaatctgctttacttaaataataacaatattatttcttctgacctataaacatgatatctctctccatttatttaggtcttctttaactttttttagccaatgttttgtagttttcaatgtacaggttttatacattgtcagatttatccctatttattttacattaaaatgctattacaaattatattttttcattttcagtttcttttctttcttttttttttttttgagatggagtcttgcactgttgcccaggctggagtgcagtggcgtgatcttggctcactgcaacctccgcctcccgggttcaagccattctcctgcctcagcctcccgagtagctgggactacaagcatctgctaccacgcccggctaattttttgtacttttagtagagatggggtttcaccatgttagccaggatggtctcgatttcctgacctcgtgatccgccctcctcggcctcccaaagtgctgggattacaggcgtgagccaccgcacccggcctcattttcagtttctaattgtttgttgctaatatatagaagtacaatgatttttgtatattgatctttatcctaaagccttgctaaattcacttactagttatggtagctttttcgtagattacactggattttctattcaaataattgtgtcatcttcaaattaagacaattctacttacgcccttcaaacatggatgttatttttttttttgtcttattgtgctggataggacgtctggtacaatgttgaataggagtgatgagagtggacatcttgatttgttcctaatcttaggaggatagcattcagcttttcaccattaaatatggtgttagctttaagtttttcatagatattttttaaaagtcaagattcagaaagttgtctcctagtttgaggttgttgaattaattttttaaatttttaataagaattagatgttggattttgtcaaatgcttttttttcatttattaggatcatatgcttttctctttagcttattggtatggcataaagtcattcacaatatttccctgattattctttaaatatttgtagaaactataggatatcaccaatctcatacctaatattggtaatttgtttcttcttttcctttctttttttctgatctgtatggatagaggcttaccaattttattaactttatcagaaaaccagcttttggtttcatcagttgctttcctattttctatttcattgacttctactttgatctttattatttcctttattctgcttactctgggtttaatttgctcttctttttctatttcttatggtggaggtgaggtcatgtatttgagaccattctttcctgataagtttttaacactatacatttctaaatactgctttagcaatcaaatcttgatacattgtattttcatttttatttaatttaaagtactttccaattttctttttgattttttctctggcctctggtaaatttagaagtctcttcataaatatttggaaattttccagatatctttctgttgttgatttctaatttaattccaccgtggccatagaacatacttgtgtgacttgagtattttttaattaattaattaactttttttttattttaagacggagtctctgtcgacaggctggagtgcagtggcgcgatctctgctcactgcaagctccgcctcccaggttcacgccattctcctgcctcagcctcccgagtagctgggactataggtgcccgccaccatgcccggctaattttttgtatttttagtagagacggggtttcacccccttagccaggacggtctcaatctcctgacctcgtgatctgcccgccttggcctcccaaagtgctgggattacaggcatgagccactgtgcctggccatgtattttttaatttatgaagtcatgttttgtgaaacagagtagggtatatcatggtaaatgtgtcatgtacacatgtcagcactttggaaggccggggtggcagatcacttgaagtcaggagttcaagaccagcctggtcaatgtggcaaaaccctgtctctactaaaaatacaaaaattaaccaggtgtggtggcgcatgcctgcaatcccagctactcaggaagctgaggcaggagaatcacttgaacctgggaggcagaggctgcagtgagctggatctcaccattgtacttcagcctgggtgacagagatgagactccgtctcaaaaaaaaaaaaaaaagatttgtgatttgttaggtagaaccagagctgtgttaatgactaatatttcctcactatgaagtgagatccttctaagtactctattgtcctatgaattatgaagtcaactggtcgggctggcataagcagctggtattgccagccctttgtaagcactgggcactgttccttctaatcctctcagatggttctttccagtcttggatagtttcctcgtatgaatatgccagttagtactctgctgaatgcttgaggatatcctccacagatctccagggttctctttatctttagctctctcctagttttctgtcctataaattctagctgcctaggtggtagctctcgacatgtggtagtagagtctgaagcctgatcagttaagttcagttccgttttgcccacgttgtgttgaaagaggtcagatactagttctttacatgaacgaaagtaacctaagaaataatctgacaactgatcaggaacacacaaagattccaaaatttctaaacacttcttttcctccataattaagttgtctttcagaaatacagagctcatgttgagtaaagtccagggccacattccctctttactccttctccatggtgccctcagtctctcctacctgtcttctctttaaggtcctgcttcctctgggggaaagcctggaagttatggagacctgatagactttgtttctggctgtatcctggaaaagcaatgtttggtcgttacagtttctcagacttatgtccttcgcaatcttctgagtagaaccagagcaaagaccacaaaccttgtttttgctgacatgggccaggtctcataggacaactgtggtgcatttaacaaagtctctgtttctctactctgtcttaccaaagatttttcttcatttgcactaaagaacataagaaaggagaatgaagggaagtgaaagctcccttccgccctcaaaggtaatactgttcaagttaaatcagttaaatcggccaagaaattaaccaccgttgttttgatgagggatgtgcctacattccaaacaatagcattttgttgggacctctctataaagagcataataacgtgtaacatggaaaacctattatatctaaacaagcaaaagctaaagaactaaaagagatcaattcttcccaaatctccaattttttttcaggtaggaaaattttatttttgtgtaggcaagtttatcagtcttttcctttctggcaagaagtagcatttaactttactctttcttgttttttttccccttgcatcaaaaattaaacttcattagctggagtcttgtcagttgtttaaaaatattaatgacctggacatcagtgaccttggataataattttagcctctgtcatttaatctgtcatcttggataagtcatcttatatcattaagagtggtttttgttatcattactagatagaagacttgatgagcttgagagatcttttgtggtggctttaacatacgtctacaaattatttgatattcctcccttcattcctctcctattgaatgtgatctggacttagtgactcacttctaaggaatcgaagaatatagaagaaatgagcgtatgtcatttctaagcctaggtcataaaacacattgcaaattcttctctttctctccctctctgcccccaaccccaaccccaaccccaagacgctttgttctgagggaagccatcttctatataatgaagggactcaggcagtcccctggagaggcccacgtggcaaggagctgaggcctcctgccaacagccagtgaggaatagaatcttgccaccaacagccatgtgagtgagtcatcttggaaatggatcctccagtgccagtcaggctttaagatgactgcagccatggctgacatcttgactgtaatctcatgagagaccctgggccagaaataagctgctcctgaattcctgaccctcagaaactgtgtaatgataaatatctgtttttaaggcattaaattttgaagtaatttgttatacagcaatataaaacaaacatatcctggaatcttacagatccttccagtttatgattccataatttaaatgcaggaggatgtatctctagttgcctgttgcttttgctaacaaactgctttgcctgttacatttaaaaactcttccttgaaacagcctgcattccatgcaacaaaacattttagacagaaaatgaaatgacattttttgaatagagatatttttcaactggatatacactattgtgatagcttatatgttttaataaaatgaagccttgggaaatttatgtcttcataaaattctgcagtgttctttggtcctcgagggccatcagaagttatgtggggccagatgcgttggctcatgcctgtaatctcagcactttgggaggctgaggcgggcagatcacttgaggtcaggaattcaagatatgcctggccaatgtggtgaaaccccgtctccactaaaaatacaaaggttagccaggtatggtggtacatgcctgtaatcccagctactcaggaggctgaggcacgagaattacttgaacctgggaggcagaggttgcagagaccccagatcacaccgctgtactccagcctgggcaacagagttaaactgcgtctcaaaaaaaaaaaaaaaaaaaaagaagaagaaaaaaaagaaaaaagaaaaagaagttacgtggatttcttgacattgtatgcaatgtgttgtgttaagagcattttccaagatagaatttgtatagcttttaccagactttcacagagccttgagccccatgtccttctccctacccaagataatagttaagaaccacttatctggttcctattcccacctgtggaaagttaggtacagagaggtgagtgactcacccacagttagagacagagatcttctgactctgaactcagtgctcagactccaatatataaaatcaattctacttagaagaggcagctcagggaagtctggtttttgcaatgccctaaagtgtgcagattctcaagacagacttttacatttattattttgctgttgcatatcttttgcttaactcatcatgctgcttcaggaaaggggtaaaatggatctttccagaaaactctcccttcctgatggacctcttggcttggttcctttcagcttagcctttacattgaagtacacaggagctcaaagtgatttatcaccatggtgcctgctagaatccaaaattattccgtgaaggaaacatattatgcttttcttacttgattactatagatatgtcacttacatgtttcttcactatattttgaaaactgcctgtttacatatagtactgttacccatgtctttctgaactaagctagatatgaatattattatcataataaattaagatgttttggttgatggactgaaaatcaaagttaagttctaatattaatgatcagaatacattctgcctatttagaaactaacagttgctaaaaaaaaaaacacccacagatgtccgaaaaataagtataaatctttgattggtgaactggaacatatcttacactcctcttatatctttcaaggtgctggtcattcatcagattctttaaatacttcatcaccagtaacactgagcattcaccataagcaagcctgggctacttaaagccggtggaacccatgttgtaaatggctggtcctaaaagtataggaaatcctgattttaccattgacttttctcaccgcaatagatttgccagccattcccaccatccctatgtgctccatgacacaatctttttgctgtggccaaagccaagtcagagaaatcataaccaaaactacagtcctggagaacctggggctgaagaatctgtgctgatgccatgaactgtccagagaaaggtctaagcttgactcctggctttccctcctcccacttagctccggaagatatctgctatgagcaggttcctgggttctgccaaatgatctagcatcatctggtcttggctactgttcaggttcagagagcactgcccctcctccccaaaggtggaaacagagattcagagccttggaaacagccccagggtttctgaatgcaaatgtttccagcaaattcagcattatatcctaacttgcaaaataattctgtagcaggaagataaagttgaatgagtcaagtactaattaggtacacttattcttccataaacaggaagatatggatatatttggcaggggggagggatatctttcacattttaaaaagtaaaaacagctctatatttaaaagtaatttcaaaatatcagattagtctcgtttgaggaatggcaggaaaatcctttgacaaagaaattaagtttatttcaaagttttcaaggggttgaactaaattatagatggcagcaaagagcagagaaaaaaatgccttgcaagttttctaaagaaaaactaaggtgagattttctaaaaggataatatattcaaaaagttatatataatatatatgtataatataatatatataatacatatttttatatatatgtatattttttaattttgagacaagatctccttgtgtcacccaggctagagtgcagtggtgtgatcatggctcactgcagccccaaactctgggctcaagcctcccaggtagctgggactacaggcacatgtcaccatgcctggctaattttttaaattttttgcagcgactggatttggccatgttgtccaggctggtctcgaactcttgggcttaagtgatcctcccactttggcctctcaaagtactgggattataggaatgagccactatgcctggtgcctcaacaagttatatttttaaaaacagggagaataaaggagaagaaaggaaaggggaggaaaaaacccttttggtaacgatggagttcaggacacaccacccccaaatatggcactgtagcatttgagaaaatagcagaggtaggaaggtcactctcacgttctcctgcccttctgccctgaagcaggtcataagacccacacgtgaaaggtactcttcctatacccagagaaaaggaacatttgtatctctgaagacacagggacacagagaagaatctgaacaaacaggtcttgctaaatttcctcagttaattaccattagggtaataaactattttttcgattctgtttctccacaattatccacttcttcatcaaagttggcatagaaatacacaagtctaggccaggggcggtggctcacgcctgtaatcccagcactttgggaggtcaaggcgggtggatcacgaggtcaggagatcgagaccttcctggctaacatggtgaaactctgtctgtactaaaaatacaaaaaattagccgggcacagtggcgggcgcctgtagtcccagctactcaggacgctgagaggcaggagaatggcgcaaacccgggaggcagagcttgcagtgagctgagatcgcgccactgcactccagcctgggcaacagagcgagactcagtctcaaaaaaaaaagaaatacacaagtctaattgtttcttcaggttttcatttcctcatgaaggctcctgtgtcacttaaaacttacgttaaatgaattggtacgcatttctcttgtttatctgtctcttgttctaggggcctcagctgtgaacttggatgggtgaggaaaagatatttttcctggctgggcaaggtggctcacgcttgtaatcccagctactcgggaggctgaggcaggagaatcgcttgaacccatgaggcagaggttgcagtgagccgagatggcgccactggactctagcctgggcaacaagagtgaaattctgcctcagaaaaaaaaaaaaaaaaaaaaaaaagatgcttttccttcactacagtgttcttctctgaaactctttaatctgaaagtttagaagttcactaaaatgaagtaatttaagaaaacaaatgtggttttcgtgattatatcaagaaaatacacctcctctatacgctgagtaagatgaatagctcagcagaatcagtagtgttaggctgtgatcacttctgctatctacaaattgctttagacgggactttgcaaagcagagtcaaaatatatacaatggaatttattttttatagtagtaatactaatatttaggagtattactttcactaggagagttgtctaaatttcagctttctaaaaagattattttgattttgaatgcactagacaccaagtatgcactgaatatgaattacaaagcaacattaaaagggaagtaaatacacattgcagaacatatgaaagtagggaagagccaagttcataagtataaattttgtatcttttactacctactatgctattattggtgctcgacaaatatttactattaaaaaacaaggtgtgtcaatggtcccgagtaattctactatgctgagtcaaatggtgactgaaaaggcttcacttaattcttttattttgcaggtattattacttggcattcacagcacatcaaacacctcttgctagcaaagagagctgtgtggctatcttggaaaagtccagattagatcactgggtactgggaaaaacaaaggtagttcgttctttattgttcaaattgtcccgtatgatttctttgtctcttgtcagtgatgtcactggcatgaatggctctgtaagttgtgtagcttagcaaacaagactccaacgtaacaatggtctttgctggtattaagtcaagaggttggggacgttagggagtagaggaggagggtttgcctcctgttctgtatgtaatttgagagctatttagcatttttagaatgagatctttgagctcatttaaaaacgtttcttttctcaatgctgcttattccagtaccacatgtaaatacacaaatcatattaacggcagtgatgagtttctagtagagttttgtccattttttcactggactcatgttatttgctgcatagcctgattattagtctcagcatctgtagcttttcatttgggagaacgtcacgtccccataggatcccaggtttttatggtccatcctgattgccttataaaaccagcctctgcctgagtgacgatggcaacactgctcctcctcagcagaaattagatcactgtggatcatctaggtacctcaccctctgaacttccactgttggctgggtcagtcctcttggttagcacctttatcagaggctatggggaaagagagtagatagagctcaaactgagaaaatgaactcctgactgacatgagacaggcctggagagcatttggaatcgcttaaaccctgttgacctcatcatctatttacatcaattatcaaggattggctcaatcttagaaggagaattgtatttacctccatgaagtcagtaatgtgagcataagtcacatcgctataaactttatttatatcattgttttaatattttcatttagaatatgctgtagtagagtgaatttctgttgaggaacccatatgtaatgctaaaactactgtctcgtttcaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggtaaatggtcctgttctcataaatactgccctgggtattggcatgtcattaagtactggggaatactcaactgtttctcttctaagtggtttccctccctcccttccttctcccctccctccctcccttccttccttccttctttccttccttccttccttctttccttccttcctttagcaaatgtgtatcaaatgtgtatcaagtgcctactacacaggttctgtgccaggtgctgaaatcacagccatgagcaagactgtgtaggggtgaaagaaactttctttccgtgtcctgaagatttgataatttgagtctataaaacaaactgagaaagacaggttaacaggagaaaagacatacaaatttattaacatgcaagtcataaaaagtgtgaaactcaaaggccagatggttgaagcttaaataccctcttcataggggagagggaagtggaggatgtagatagttttaagggaagattcaaaggtttacgagggaaatgaatgggcctaaggaacaggcaatagcctgggacaaagttcatctgacctctgggtgatatttactccagtctttcttcctggggtatgcatcagtttctcctggttgaggagatatctggggaagggattcacacagttgaatatcttctggaggagtttgcctttaatagatagggagagttcagagaaagcccttccctgcatttgctgctacccaggtgctctaagtttgaagtcaaagcagcatattttggagaattattatctgagccccaacaactgccatggtccctgacttgcaggtaagcaaacaagtctttacaacatgagtgacaggatagatagtggcggtataaatggaccagtgatgtaaagccccagtcacacagatatgtgccgcatctcccagaatgactgagataatatacacttcaggtctgtggtcaggtgttcagtaccagagttactaacgccatttccagaaggcttttctagtccagatggaacttataaaccaagggaagaggttgctaatctctttcatgtgccctgcctagtcagtgcctctttgtttacgtatatgtgttattagtgttacacacaacatttaagttcctgtgcaatagacaaatgattatgaaagcaccagatcttgaacaaagtggatgatttcccttatgctctcataacccagaatcctcatgtggctcagtctattttggacttcatgagctcacccagcaacttcgagagttgtgatgctgagacgggaggaacaaagacattatgctcctcgtgggtggcttaatgccccagttttgtatctaaagggcttaccacctttgccccagagagtcccttcctcttttctctctttttcttcacctttcttccctgccttttcccttcccactgcacatctttcctctccctcagcatacctctcggcacagaattcactcacagcaaatgacagtgttgtgctacttatcatttcccttaactccgctctttctcttcttcaactttcctgtttatatttttctcccaaataacagattttgaaagggtcaggctattccagttcctttctaccatccctgccaaacccttccacctgtatcatatccccgagtcttgaagacagggctttctccagggattagaatgacaggaaaccatctcacctggagtaggggtcccatgtgattcatcagtggaacccagagtgttctggaaatcactgcctgaacaaaagcaacccctcagaagcatctttaaagccaagctgtgagaacagagaggcctctcttctcgccatagatcacatacctctgcttattttgttcagtgagaaagcaggagggaggatgagacgggcaataggctggaggggaaaacagcttatatcaattctctggcacgttcttaaattaatgtcattcctagcacatggttttatatttttagcctggagaggatatgatgctcggaggaaatttaagaaaataagcaacagaaggaatgagtctgctgctcataatcaagcaggtaattaaaacatcattttcacagtgtccacttgaaaatattctgtgactaacttctgtgaatgtagaaaagctgaaaggttaataattcaggagcactggaatgagtcaagagttctgggagacaggagtcctagtgttctgaccctccttgtgtgataactatgatgctaacggtgagcatgagcatttgctgtttgccacacttggctaaggatgctctgactgggttctcttgtatacctgatattatagaggaggaaactgaggcactgagaagtgaagggacttgtccaccatcacacagttcatcagttgcagagccagcatttgaacacaggccgtttggatagagtcagcatcgcatactgccacctgaacaaaaccctttccctctcggagtcatatgtccctcgtctgttaaatgagagcgctggttaaaaaggtccagaaggtgccttcccattttggaattctctaattatatgcaagacctgtttcttagcatcacagaggaggaatcactcagggagtttcccagcaaactgtttcccaaatccaggcttatatgtggctatcatggtcctctgggccccatggcatgagcacatggtggcttttatggctcggcttgctattggcagcctgagaggtgtaagctctggtttctgactcatccgtcccctctctggctcttcagtcactctgctcttctgcaaatggcagtgtccactgtgggtgcgggtgccaggctgggctccttccctcatttgaagctgcatattcctactcgaggctctggaagaaacaggcccctgagctccaggagccacaagaaattagagacagaatgagagaaatagccaggctggtagactcagcagcagagagagtgataggatttcacatacagctgagcttgaaggaaactcttaaataaaacagctgcaacctcttgaaagaagtccctcctcggaacctggctccaagtaaacttctcagaactcttagaccactgtagaagcctgatgtcttcattcaaaacgaaaatagttgggcggaaagagtgctattaaaatgcaaatgttaacttttaacaccatctcctaggaattctaagctctacaacttcaaagccccaggaagagggatgcaattcttgttacagcttaagagagaactcaaagtgcatcatttgttccctacttgcctgcctcccaacacgcacacaatctctcattaaaacagggtaccaaactgatttctgatcttgcagtttggtacaaaggccaacatgtgttttaaaatttaaacttgcttgagcttatttattgttgatccactgagttcagtatacaggaatcataaatccaattttccctaagtgaaagtcatcttttgagtgctccctgtcttgcactctgttaatgccaagtgaatactgctgtaaaacagaaatgggtctgcttcatcatcatggatcaggatagtaataattgtatcttttcagtggagcacctatggggtagctaccatggaaggataatgttgctcagcgaaactttaaaaagcatgtttctttaagggtgtctcccttttttttttttttttttagccttgcaagcacccagcaggactttagaaaacacattaaggtgccttccttttttttagccttgcaagcacccagcaggactttagaaaacacattaaggtgccttccttttttttagccttgcaagcacccagcaggactttagaaaacacatttctttaagggtgccgtccttttttttttttagccttgcaagcacctcccctttcttagccttgcagccaaagtgttcttgcctatcaagtgatgttgggaacttccattaactgagtctgcaggggcttagatgggcatgaaggtggcaccaacaccacctctgccctcttagaagtagtgtggcagccagagcaaaggcagacagcatctgccctttagccaacaccgtggacaggaattggtgcgctggttttgtgttggtggtaaagatgcatgaatagggtagcaatctttgcaattttatgggcagtttacttttacttgggaatattttccttatctttagatttgaaggcataattgcgtttatctaagaagcaaagcaactcattccgacgtttctgtttggggttgtgatcttccccaaacataatctcattacaagcctctcttcgtcccactaggacatttcctagtagaaccagacccagatacagtggctccccgctttaggagcctgcaggaagtggcttagggatgttgtcacagcacaaccatttccggttgttttctaaggttattctctaatttattattttttcaacaaatcatttcatttgaaatttagattctgtggaatgcatttgtatttctagttctggcccatagtattttcttaagtggtgttgctaagatatgttatatatttttaaaagagcggcccttgaaatttaggaagcatttggcctacatgttgctacagggcagcacatattgaaatttgttttcctttcatctccttcccaataaaagcagccgtgcggcttatccctttagcttcctcagaacttcctttcagaattcccgatctattacggcacattcacataccagaaacaagatgccttttcatgctgtcaacctttttcatctgaaatgtaaattaattcttgctggtatgccttgacagagatcaaagtcagggtattaaccttcccaggctttctcctcataaggactgggcggccaccattaggaactctgtgtccttgttatcgggccctcctccaggcagccctcggtctaggagccaccatttcaaagcctcagagtccttggtaaatgtcctcatcattactttcaactgggtgagaaataatctgcctggctaattattgctcgtttttaattgtgggcccttcattcagattccaggagcaggtttcagtgattctgacagccagtggtcttggtgtgatcgagggagggacagggctccagattggaaacctctcccccaactcagtgggtcatttcttgcctgtcagtctttgaggtaggccacatttgcattttcaaaataaacagatgcctttcaaatacatgagctggtggtctagagatctctgcgggcccaaacagttcaccagccagtaatcaaatgctggaagagaaaacaaacggaaaaaaaataccctgggtacacaaggatacatttcctatgtgtataacactgcacagtcaataaagggcctttatgagatgtaggggggagaggggagaggggagaggaagagaaagtaaaggagcctgagcaaaggtattgtctatcagtttcttttctgcggggctgagggaggtgggaagcaactctgcatatcaccttggcaagaagtggcatgtttcattgttttttgtactggttaattctgacaatgggttcttgccacaggaaaacacattcctttaaatgccaaataattaaaatacatactttgttaaaatccgaaaaaaattgtacatattagtgttcaaatagatggtgtattctaagtaaaaactaacagtgaccttgattccattactaatctgttatatttttaaattaccttatgtttcagaaattggacctaactacatttattcaaccaaaaaaagcttacattcctcagtgaaaattatcaaaacaaactaactgcagggaactttattaaagacctacatgtaatatctcattcattaatttttctaaagctctggctttaaaactgcccctctaattcaggatatgtgttttagatgagagcaaagttgtgggcctccctctctcaaaggagaaatgccctttgaataggtgacagtggagccctaggggctggaaccttctcccaggaggagtggtcttccagcacctcactgcttctccccacacacacgcacaggagtcggaagagacgctagtttacaggacattttcatctaattgcttcagtgctgtggaaattgttattttctctttctctctgttgttggatcagcttcctacatactcccctccttggccctgccaaaaacacagatgttatcacaagataacaatagctctaacagtgacggccatttctcttctgatgctctttggggagagtgcttttcccagcatcagcagagactctgacgaggctggcagggtgccttccttgagcctgtgaacaggcattttaagccactgcagctgggaaccactgggcacatcatgtgatgcatgcagagcagagttgctttaaatgctgctaccagaagagaaagcaaacatcgtatccagacagcctgaccctactttgtaacagaaccaagtttttggtgtataaaactgcctgaacttttaaactctttcagtgcaaggttttctcctagccttttcaaaaggctgtttaaaaggctgtttcctttagcatcatcagtgggttggcaatgattaggtggttgtaatttcctagaactaaatttcccgctatttgcctacgtgtgcaggacaactatatttaaactgggatatttctttcattcacttacttaactactatttgttaagcacctactttatgctggggctcccacggtaaacaatgagatttaatttggggcttcaaattatccaactccaatacagagcactctaaaatatgctttccctcaaagggatgctgtttgaataaatcaagtactctgtattttgccaacgctctttggaatggagctctgtaaaatctaaaacaatacaaagagtacaaattattataaaacacagccaagtgtatgcattgaaatgacccatgcttcttgaaggtaaaaatgactgtagtagatatttttcatcctgctaaagctgtacataagtagattgttgatcccaagccaaacaagagggggactgtaagtaaatgcaccattgaaagaaaaggtccattttgaacaaacagaaggaaaacaagcatgccctctgtcactcttttctgtgtctctatttgtagttctacctctatttcactttttcttcactcatttcatttctatttcttagatccctggtcatttcacacaaaagctaaattcttcaaactcactgtctttatcagaggaagcacaggtgtgagagaagacaagatccaaactcttcttggccgtagggcaggaggcagctgcttctcttttcctggtgttttccgtatccacatatccacagaatagcaataaaacatctgggggaaataatttacctggtgcacctgagcttgagatgcactgtgaactgcaaactagccctccccatccgcctacccccccatcttctaaacctttgtttaacacaagacaggatgcccttcagtcctaggcgaggggtcctgctcacttcactctcatgctatcttggtttccctagctctcccatacttgagaaagtggggctttctttctttctttttctttttcttttttttgagatggagtctcactctgtcacccaggctggggtgcaatggtgcgttcttggctcactgcaatctccccttcctgagttcaagggattctcctgcctcagcctcccaagtagctaggattacagacatgcaccaccacacccagctcttttattagtagagatggggtttcaccacattggtcaggctggtctcaaactcctgacctcaagtgatccgcacgcctcagcctcccaaagtgctgggattacaggcgtgagctactgtgcctggcctggggctgatttctgacagctgcaggcttaacatatcttgtagggggaaatgtctagggggaaagcattgtggtttacttgaggaaaacataccttgtctgtgacaaggcttagagcaagtggtgtagtacagagacaggatggcctgtggtttcgaggtttctgacaagaaatgagctctgccaaatctctctttggcacaaacgatagaatttttgtcatggcatagcttggaatgcacaggaatctcctttgctatggaataaaattattgcccatgctaggattaaataagccagagggcagaatactgtttacctaatgcacagagaggaagctgcaaagtcattgtgggctggaggtccacttgtgcccaatatcataccggcatggcacaagtatgcttaagatgaaacttttgtgcaacagtaggtacccctaggactcgatattataacttcagaggacgccagggttagagcctacaatctggaatcagttttctccattatgaaccttgtttagcattccagagtctagctgcaaagaagtggtgcctgaaaaggtatctttgccacctcaacacagaatgaaacaacattattatgatcgattacacacttgagttgcctttactctatgtctttaaaacaatttcatgtagaatcataaaatatgttatcacattttataacttttattagttgtttagactgtaactacacaatagtaaagaaacgtttaggggaaagctaactgggctgtggcaagaatgatcatgctatttttcttcaaaagactcttggaaatagaaaggcaggctttgttttacctcttaacagaggaaccaggagcacagagagttaaataagttgtgtctcccttatgtgttctgcaagtttaaacactggtttcagagccctcttcagagccttcactcagtgctcttttcagtagaccatgccctgccattggtttccatcttgaatatgacacattggaaataaggtaccagtcaaagctttggaaagagttgaaatactgtcctaggcatgtggagtttagagtcaaacaatgaatgttaaatgatggctatgctgccatttgccatgtagtttggggaaaagtacttaacttctgagccttagtttcctcagctgtaaaatgggactcattaaggcctaatcctcaggactgctatgaaaatgatagcaggtaatatatgcaaagcatcctgcacagtacctggctcatggtacgtattcactaaatgaaatgttacttccctctctgtactcccttcctaaatgtcaacttcactgggggggaaaaaagtctgtgaaatactcttctatggaggacataataatgctgtaacttcaggccgggcacagtggctcaagcatataatccccgcactttgggaggccgaggcgggtggatcacttgaggtcaggagtttgagaccagcctggccaacatggcaaaatcctgtctctactaaaaacacaaaaattagctggacatggtggcgcatgcctgtaatcccaggtacttgggaggctgagcagggaggattgcatgaacccaggaggcataggttgcagtgagccaagatcgcaccactgcactccaatctgggtgacacggtgagaccctgtctcaaaaaaacaaaaacaaaatgctataacttcaaaaagatgaaacaatttctttcatttctggagaaaaatagtacctgtcaaatctcaaattagattacagtaaaatctttgtaaaaagaattttccaagtcttaacttacgtcttgtttatttgacagggaaaaaatagaatacaacaataacatgtaagagatttcaagtggttttgtttttgttttttgtgaagagctgtgctccattcatgctgaaaccttgattcatttgtgtatataaaattttcaggaagctcaaaattgttaagacttaggtgtgctcctgacatcatttgtccccctcactagtttgaggcccttttgcaacttgttctgaaagatagcaagttccattgtcaccctgcttctgtaaagccagaaattctaaaatctaggagctaaatatcaccagatttgttgccttctggtgtggaaagcaagttgcctttcagatgtctgaagagttggaagatcttggtgtacctatcatgtttaacccacagtgacgggtgatgggcagcctaacagctgaacgacagccgtttggccgggagttcaaacctcaacacgatgagccatagcaggatcacggtttgatttgctgtggccatgaagtctgaatcaccaaatacagaagcagaggcaagggtgacagctggtagccattctcgtcaataaagttgtgacagttgagatgtacaagtaactagagcctgctaatttcatagactttgagccaagtgcttagtgtcaaaaccagctatggtcagtgatgcaaatggttgtgaaaagtccctcatcagcagcaagactctccccatcagactctttcctctgatggattagaagcaaattggatcctgctttctaggaatagatccagtttgaagaaaaggaggccttattttttaaaattctagtaaattcttaaaagtctattaagtataatttacatacagtaaaattcagtttgagaacactagatcccctccataatcaagaaaaagaacaaggagacacaggtccttcctccaaggagcttgcattctaatacagaaagtaagaataaaaagagattaaagatatgaaagcacctgaaacttttaaggggggtgtgtcagtttgactagtgatatcccaaaattcatgtccattcagaacctcagaatgtgactttagttggaaacaggatttttgcagatgtagttaattaaaaatgaggtcatactggatgaaggtgggtcctgaagccaatgactggtgtccttataaacatgccatgtgaaggcacaaagaagaactccaaaaagttcccttatgcccttcttgacatccacccccctcaccctcagcccctgataaccactaatgggttttctgtcctatagtcttacctcttccagagtcttgtccttatagtcttgacactgtaaatggagtcatacagcgtgaaacttttgagtctggcttttttcacttagcataatgcttctgagattcatctgcgtgttgcgttttttagtagttcatttattttcattgctgagcagaatttcagtgtatagatgtaccacaattttattcatttaccagctgaaggacaattggattgtttccagttcttggtgattatgaataaagctgctataaacatttagagcattttccttttgttttttttttttttttgagacggagtctcactctgtcgcctaggctggagtgcagtggtgcgatctcagctcactgcaaactccgcctcccaggttcatgccattctcctgcctcagactcccaagtagctgggactacaggcgcccgccaccacgcccagctaatttttttttttttgtatttttagtagagacggggtttcaccgtgttagctaggatggtctcgatctcctgacctcgtgatccgcctgcctcggcttcccaaagtgctaggattacaggcgtgagccaccgcgcccagccttagagcattttccttttgagtaaaatgtatagtaaagtaaataactttgcttcacaggaaaccagaactgtaggagcaggaatgatcctagaggtggaagttgttttctttttgattagctgacaggtatagttattttatacttttgcatagcaatttatagtctattcaaagcactttcacacaccttacttcctgtaattatcattatagtaaccctgagaagtaggctaggaatcttgcttcattttacagatagaagctaggaaatctcatataatccagacttcctaatccttatttgctgtcgttccttctaaacattttctcaacatcctgtctgtgcagaacagtctgctagattcttttggggtacccacaaaatattttttcccatcaagacggagcagtcttacatggaatcaaactgaccactctggcccaggcttgaaaggaatacaaaactgggccacttaacacagccacaagaagcagtctatgaagctaccagaagcaggcaggacataaattttaagaaagaaatcctgaagctggtgggagtcagaaaataatggattgacggtccctagatgatcagaaggaaggggaattccccagacaatgctgtttcaggacaagcaagaaactgatttctaggataatggaaaacttccctccttggcttccaggttggggaaaacacttaccagggaagattttctttgaactcaaagtttaactgggataatgactggaattaagtactggataatcaaagtggaaaatgctttcagaggcctgaaattactagacttgttttgtgtggtagagatagaggccaggatttcttatagggctgtagaaaaaaaaaatgtgtcaatgagattctattccttaagaatccaactttcttggtgctgcttttggtggcatttgcctgtcagacctcccacaagttggcctctttatcctttatattctgataagatggctgatgaccagctgtcagtccaagccagaaaccacactggctccttgtaaaatctgccagcagcagttaggaggggaagcctgggcttttgtgcctcatccgtatgagccttctctgccagatacagtgggtgccctttgccaggcccattatgagggcaggaacgtttacccagcctagatcaccaaccaggaaacctaccaggacagtgtctctgctgaaacaatgcctgatctgtcctttgggtgggtcactaaatgccaggccaggccagagcctctttctgcagcagctaatctatgggaccattagaggcccaagcacatgaaagaatgtaacaaaggtctgatttttttactttcatttataaagggggaaaaaaaaggagaatagggattattattttgaaatgtttaaataaatgacctgcatcatgtaatatttaggagttcagactttaggaaaaaattttgtgcttgggttcaaatcctggctctgccagtctacagctgtgtgactttgggcaagtcatttaacctccccttgtctcaatttcctcagctgtaaaatgggaataaagtagtcgctctcttttagggttactatgagcattaaatgagttaatgtttgcaaagggctgagaacaatgcatggaacataataatccatatgtatgataatgtttgttaaataaaaataatggagcttttcttcccacccaatttttccccgcacaccccagccaaatcaagctgaaagtacctaccgttcagcttgatcttgtccttctctttcttctaatttcagtacttaacatctgtcatgccactccccaaccccaaaattagattcctagggctgccataacaaattaccacaaactgtgtagctgaaaacaacagaaacttattctgtcacagttctagaggctagaagtccatcaaggtgtcagcaacattggtttctactggaggttctgagggagagtctgttccaagtctctctccagtctcctgttggttcctggcaatccttggccttccttggtttgtagacccatcacttcactctcagtttccattgccatatgcgttctcactgagtctctctgtgtcttcacgtggcctgtttatgaggacaccagtcattggctttaggacccaccttcatccagtatgacctcatttttaactaactacatctgcaaaaaccctgtttccaactaaagtcacattctgaggttctgaatggacatgaattttgggatatcactagtcaaactgacacacccccttaaaagtttcaggtgctttcatatctttaatctcttcttattcttactttctgtattcgaatgtgagctccttggaggaagggcctgtgtctctttaatttactttgaggcagctagaaatgtttatttggccacttgaaaggattggagagacaagggtgacaccaagttgggtgtggaaaggtgatgcctgagatggaggagtcaaccagaaggagggagaaagacaggattttaaaaaatcacatctgaacaaataataaaggagaaaggtcagggataccaaatattctaatgtggtatatttggaagcactgctgccggaaatagaaattgccaaagccagaaggaaggtgcaagaagtgagaacaaggtgtaggtaagaggccaggaaaagaggagatggggacagggttattgcctcggggcaggaccagaaaaaatctcctccgtgaggaggggcagtcctgctgccagtgtagtttctgtctaaagtcaggagatccaatggaaagaacctgccttctccagatatctgaggtaaaagatgttggaacatcttcagccgctcgtgaccttgaggtcatggagaacggaagaagagatgtgacagctgggaaaatccctggtagagccattatgttgtggaatccaaaaggaagtaagctgactggacaatgagaagctgcaatgtgatattcctcaagtgaatatagtatgtagtccatcttctccctgacagcataataaaaatctatgatcagggctgcgagttcacaggaagggaggggcacttccaagaggcagagatgtggaggagaaaacggagcagcttcctgggagagagctcacccttctgtttacttccctggtagtggcaactgaaagacagcaggaaagctatccagtgaccaaaccaagaatcctagcctggtgcactcatgacctgtgtttgtcactgagtttccctatttgactaatgtgatcagtgacacagtttccccaaattacccaatgtcatccagctagtagagaatctggccagaacaattattaattctgctgtttcctactattgtgccctttctcaactacactgtattaaatcttaaaaataagcaccaagttcataagtgagattagtcaccttggtgccttgaaccgtaagaaaagtgtggattttcctggccaacttgtatcacccagtttggtaattcatctaggtgtgggagcataaccttgagaaagtctttttgtttcattccacaggggacacttcaaaccaaagcagtgggccacattcccccgtcgcagcaggtacgaggggaagtgccgaggttcaagactgcagcgagcctggtgaccataaaggtagagtctttcgagatttagaatgagtgttctaaattcaggggcattccggagaaggttccaaagctggaagtgatcacctcttatataagaaccttctgtccaccactccttcttttttctataggtgacagccaattaaatttaaggccaaccttgcagaggactctgaagggtgatttcatagaagggaatagaatagatggggataagctccgttcctcacagttgcccctccacctccttccatgttccctggaacactggtctagttgcagctctccttaccaatggcttcgccttaacctgtcctcttgaggcagactctgacatgtttgtatcagatttaccttaagactgaggaaagtttagtgtcttgggaagatctttctatgatccagaacctggtatatagatctcagactgattgagaacattcatggaaggaaggggtactgtggacaagaagtggaaacgtgggtttctggttctcagtcctccaccagttaatatccctaagctccagtcacggtaacatgagacaattggactaaatcatggttttcaaacatttttaaaatattgcagtctcacccttttgaattttgaaggtccctggacttctgcttgagaggctatgatttttgaagtatggtctttaatgccagcacctgcatttgatggcaagtgaagattttgtggtagaatttacagttacagtttatctgccagccccagcgccactgcccagtgtgtaggcagagagtctctgggtacctcagactcctttagtatctctcactcagtctgtttcaaggaaatactgaactggaactttaccttggggcaaggaggttagaaagtaggagaaaaagagaagtagcaggatccaggagaacatcagtgtttcttgaacttgaggagacttggggatggagacaatgagaaagttttcattttcaaaagaagggtgtctggctattactgactgagggtgcagatcactgtttccccctagaagtcacaaataggagatcctccagtataggaagtcacaaataggagatcctccaaagatgtgttatgcttggccacacacagtgctttttaaaaaactttgaacctgaatgtctttaagtggggtgtgaattctctggttcatcacaaatcccacgattccccatcctctttgcctgatacttcacacatttatatttcttcctacgtgcccccaaaggcatttgcaacacctcctaatggtgttcttggtgttttttgttgttttttttttctgacaggcagatgcttttccatcttacttcaaaatagtctgatagagatgggcgcggtggctcacgcctgtaatcccagcactttgggaggccgagatgggcagatcacgaggtcaggagatacagaccatcctggctaacacacaatgaaaccccatctctactaaaaatacaaaaaattaggcgggcatggcggcaggcacctgtagtcccagctgcttgggaggctgaggcaggagaatggtgtgaacccgtgaggcagagcttgcagtgagccgagatcgcgccactgaactacagcctgggcaacagagccagactccgtctcaaaaaaaaaaaaaaaaaatgtgaatggcttatagagctcaaccagattttggaaggatttagttcctctagaactccactccaagtattgctttacttcattaaaccagaaacacataggaaccctccctgatgaaaggtgacccatctctagcgaagcttctattgtcacacctgtacattccccaagttcggcattttatgaatatttctactatttaagttcataattttatttttcagccatgtcactggtctaatttttttttaactcaacctattcatacacttaaaatgagtcaccttctctctcttttttttccttcatatctccatttctccaatgtccttgttcagcaattcatttgccagagagaagccaggtgattccaactgtcaccagctcatactgaaaactgtttgacaatttcggatgctgccttgaattcagtggtttgataatcttatttatctctttagtttgacccaaatccttctccctgttcttcagcaaagctgggggatggaggagcagattccttctaagctttattcagaatattctgtaagtttctggttttatacttcaaataactcttaaaaatcaatattttgatgactgaagtgtaaattaataagaaacatggaataagttttcccttcaattacatgaacagaaattctatggaaaccccagcaaagtagctgggggcatttgctgaaccaggtaaagatattgcttcctctcgttctggtcttggacatggcaccttcataaggagagtcccaaaccaaaagagattttacagttttttttttctagatctctttgtgctattttcttctttggatggctattgctccttattatttttagttttttaactgaggatctcaaaataggtacagacaaaagcttgcaatcttagctttccacaagggcaatatcatttggcctttgatcagtggtagctcttggtgctgctgatttgggccagagaacaaggttaaaaattatttgtggtgatttttccttcttaacagggaaacagaaagatacttgtatccctgaagtgggttccccttttttgtttttatgtcagttcttgcttttatgttgcttatcacagcattgcaagtgagtgtgggccaaacagtgatttagaatctccaagaggggggaaaacctgcctggtgctctaactagaggattttatcaacggagaaaaggcagtgggggaagggaagggaattagttaatgaaattctaacaggtggtggctatttttctttatttctattttttccttctttcaatattgttgtttcactgtttggccataatgtttgtgtgtgtgtgtgtgtgtgtgtgtaataataaaaattgtattaatgtctcacttaaatttttctcttttggtgtttgtagcaataataacaacaacaacaaatctttctatccattaccttagctcaaagaattgcatttattccacacaagaaatatttatgctgaggaaccaaactgacaatttaaaatcagcacatgttcttcccagaacagacaacacaaaaaaaactgatttctatactttttatttatttttctacactccatttctatcatgtattctgtaatcataatgtcaaccatttatgcatcttccacagtaagtcacaattcccaaatttatagattatctttgttggttacttttcagtttggatggttctaggttatctaaaataaggatggcaaataggtgtgcagtctccttccaaccctaactgatgggtagtgactacttggaacagtggttctcagccctggccacatattaaaattgtctagggagcttttaataattgatggcagttcccatcccagatcaatatcagaatgtctaggggctggtcctaggcatgtttaaaatcttcctgggtgtttctaatgtacagccaggagtaagactcactgatctggaagcagtgtctctcaaaatttaacatggatcaaggtcacctggacagcttgataaaaacacagattgccagaccctacctgcagagtctctgattcactaagtccgaagttgggcccaagaatgttcatttctagtaagtttccaggtgatgttgatgctacttgttgggccacactttgacaaccactgatgtgaagtgttaagaaggaacttcaggttgaattaaagttcagtggaaaagaaggccgtgattgattagccatggtcactggaagaaagaattgtatttgttaccctcattgttgagaaactcatcaataaactgtcctcaatcaaaatgtggaaataggttactcctggaattattccctgtttacagttaatcctagccacatcatcacattttgctccttgccctatccacatcagcaagcagcctagccagaactagaagctgatctgctgtctctgtctagcacagtgttgttccagctgttgtatactgcttctaccgggacccaaatcacttggggcctctaatctgtgcactctttatatctattgccagagagaggtagcttgttttcctataagcatgaaaacagtttgctgactgagaccaagcatggaacaagacctggaatcgagaacagctcaattttaatgacatatcctagaaaaaaaacctatagaaagtcacggagtggtatgagggcagggagagaagggctgcagagagtgtagatgggcaccaaaagctaaccctacctacttctgaacatatgcttagccctcctttcttttctctcagttctcaggggctctgtacatcgtaggagccattcacaagcagaatccaacaatggccgtacacagacttcaagcaactctcctgctgtcacagagaaaaatgggtgagcattatctgctaagagttccctgttgtaaactcaggtgctccattctaatggataatgaaatggtaatggataatgcaacaagtatttctaccactatggtattttggtgaactggagagagtggaaccaaaaagcgtttccagggctgggcgtggtggctcatgcctgtaatcccagcactttgtgggggccgaggtgggtggatcacctgaggtcaggagtttgagactagcctggcccacatggcaaaaccccgcctctactaaaaatacaaaaatgagctggccatggtggcatgtgcctgtaatcccagctactcaggaggctgaggcaggagaatcacttgaaccatggaggtggaggttgcagtgagccaagattgtgccactgcacttcagcctgggcaacacagcaagactctgtctcaaaaaaaaaaaaaaaaaaaaaaagtgtttccatcagattctcccaagtctttattctacagagcaacgtgaacacaaccctactttttgggttctcttcatggttaaatctatacttagcgtcatcaggttaaacatcctccccctggatatttagcaatgtctgaagacatttttgtttgtcacaactttggagggaagagttgtgcagttggcatctaatgggcagaagcctgtgatgctgctaaacctcctgcaatgtaggacaaagcctccccgcagcaaagaattgtccagcctcagatgtcagtagtcccacagttgagaaacctacagccaggcatggtggtatgtgcctggagacccaggtaattgggaggctgaggtgggagtatcactttagcccaggaatttgagtccagcctaggaaatatagttagaccctgtctccatattaaaatatgtatatatatacacatatatatatacacacacatatatatacacatatatatatacacacatatatacacacacacacatatatatataatctcatttgggggagatatatatattatctcatttgagtagaaaaatgatgagcttctagaaaaaccctagatttaagctaaagcaaaaagggagtatcatttcctgtttagccacaggtttgagttaaatataattcaaaaggagtatagcagagcttgcctttcagtgacctctgagctgctcaagctgcagggcccgataccctggctaaatgtaggctcaagacactttaagtccagccaggccaggcatgacaccaagagctaaagacacaaacagctcctaggcctgttcttcacggaagcctttataatgtgccttctctcagataaggtttccagaacccatcatgtatgtcaccaggaggaggacacagctacaggaaggagtggaccatggcaaagggaaggcctaatagaatgaaactcacctttcttattttcttccacattgattatggggaacttccttaaaagttttagtcaaagatttcaagaaagaagcaggtcattagagagttctttgcatcttttcacctggaaaagagaaagtcttaatttacaattttaaacaaaattttaattattttttattattttattttgtgagatcgcttaagatttttgagacttgataaattaaattcttaatactcccccagtggtctcaaattgtcattgggcttcttttaaagtaaagtactttagactacttgcttaaaaagtcagaatagctcatttaagggcactttaggaaaagacctaatatctcatattagaataacaaagtttacaatttctaatgtggtagaaagatcactgagcttggttggaagacttggtttctgatcccagctaacattttccaactgtttgaccttgggcaagtcagtgaaccagtttggaaaacaacttcagccccagtctgacttcctcaatctcaactgaggtctgactttactgagaacaccaggacagtgctctgagctcttccaccgcccttctcttcaccttagaatctctccttatcttcggctgtccttccttcctttgctcccatctcacagaccccagatcctctgccttgtgcagtgttcctgccatccaggccctaccactatcaggtagcacctcccctgctttcccatcttttacactctgctatcactttccattttgcttatacctccccccatactaaaaaaaagcctgcccttggcctgtccttccttctttttgcttttaccaccagacttcctccaactgctgtccaggtccactgcctcatttcctcactaaaccaacccctttctccctaatcctgaaatctgatttgtgtccctacaatgtccctaaaactattcttgggaagcacagctcccagttgctagagctttatgttcatcagactctgcagcatttagttccatgggccatgcgtgctttccttgaagagccctcttccaagggtatctgtagtattgccttcttcaggtgcttgctcagaggtattctcagtctttgttttctctggttccattcttcttctcttccgcttaccattaaaataaaggcaattctccaagtcttagattctctcctttctctccttctcaccctggatgataccatctctcaccagtgtgttctggtatcaagtctctgctaggtgagcacgagtcgcaagtctctgttctgagctccacactcctacacccaactcacagtggacatatattcctgattcacacaccaagacttcaacagaaaagcccctcctaaagcacctcctccactcacccttcccacttctatgattgacataaacactgtcttgtgacctggccttcaaacctggcacagtcactcttgacccctacctctcacttaatctcacttccagtcattttccaaatactctttcctggtccaggactgccattatctctttttctttctccttctgtctttacagtccagctttcatttctcacacctgatcaattgtcttacaacatattctgacttgttcaaagaactttaatggcttcctattttagaccaaaaaaggttccgacttctcaggctgctgttccacgcctctctctagctcacttcagtttgtcctccaggctcacctccaccttgtccctaatacaccttatggctaaccagaatcagacttcttattgttctaccggtgcaccttcctctcttctctctgcccattcctttctgttcagctcttaccttttggtcaagacacattatcatatccctttcctccatgaagacctaattctttttaatactccttgagctgtagcccttttgtaacagtactactcaaagtgctttttcacaacaggataatgaatttgtgcccaaatgtaaatcaactcactgctttcttcattaagaaactcttgttactaaaaaaaatcagctgaactaaacaatgtacttggtgatgaattgatttacattctggcactagccccttatgtcattgtgagtagtaacagttcacagactgggtcctcacaccacactttggtgtttcaatctctctggtgctcttcatattttgcctggtgttatggttgaccttgtgctagcaagttagcttctcaacagtgaggactgagtcttactctttcttgtatccgatatacacaatagctactcaataagtttattgagctaactttcaaagccacttctcagcactcagatttttatgagggaagtgtttttcttgtcagtctttgggtagtggcaacaataagaggatcccgaataacttaccaaacagtgggccagggtatccctgatccagggactgggattctgttgtcccccttatgtttgtcaactcagtgttctgtgaatcaacaagggctgataggaaggagtttttgggcagagggtggggtgggagtagggaggggtttggggtgggcagagtaagaagagagctggattgtgtcactggtgatgttctcattggaagtaacaaacattcaacccatagattcaaggatccctcgagacaaaaggtccaaagacagaagttccagggctcggtcagccattcaggaatgtcagcaaagacacaggccccttgcatctctttgctttgctgttctcagcatgtcagtcatgcccccacttatggccacgaggtggccaaagcaacactaaacatcacttctttacatgccaatgtctggagcaggaagacagaagcggatggaaaggggcttcttctcaggagtctctctccatttgctaggagggaaatctttcccagaagtcacccaggagacttttcttgcatatgattggccagaatttgcagtggtggttctgcaggagagctgcaaaggaggttgagagattaggcaaagaagaaaggaagagggaagcaaccaacaaggtctgcctcaagagtcctggagagacagtgatgggagcagataggtaccaggaaaagatgaagggaaggcaaaatcagagggaagagttcataaggacgatccgtatatgtcaagaaatattgctgcaaataagaactgaagggaagtgttgagatcattcagattgattgttagcatttattgctatgccagttttttttccccccacattttatctcatgtaattctcacaccagccttctgggttggtgttactcactctatgttacagataaactgaacctggggaaagctaaggcaaatagctcataaacattatctcagagaccagtgctggattggtttcagatctacctacacctgccccccatcagctagtcgaggaatcactgggttatgcagggtcacacagaataaatggtgggtctgggctttgaattcagatcttctgtctccaacaataataacaactgctagcatttggttcattagcaatttcctgggcactgtgctaagtggttttgtttttgttttttgagatggagtttcactctgttgctcaggctggagtgcaatagcatgatctcagctgactgcaacctccgccctctgggttcaagtgattctcctgcctcagcctcccgagtagctgggattacaggtgcgtgccataacacctggctaatttttgtgtttttagtggagatggggttttaccatgttggtcaggctgatctcgaactcctgacgttctagcgattcgtccccctcaggctcccaaagtgctgggattataggcatgagccaccgtgcctggcctgtgctgagggttttacacgcattatcctgttcaaccttatgggaaaggtatagattttacaatctctgacattgagagatcacaagtaacttgccaatgttacttaatcagtaaagtgacagaatcaggatttgaacatgggccttctgaccacagcactcattttttaactggtacattctactgcctctcaaggctccaggtctcagataattagtccaaggctttttctctctacccacgttgtctctatacctgtcattgtttaaatcttaaatcaccacccactgagaaatacaccctacttgttataactgtcaccctgtgattgatgaagaaaattccagcacccagttcttgggagaaagcctaaagcctcatgggaaaggtgctcccatctgtgcatgatgggacagagttaacttggctggagagaaggaaacctcaagttgaaagtaaaagtgagtggttgggttgatgcttctctgcttcacttcctatgtgagcctgtaactgtgtacagtgaatgccaaaatggaaatagtcttttatgttgtggggctttgttcccatgatggtaatcccccattttaatgctgataaatacaatggtgaggattatgccccttaatttaatttggcctgcatatggcaaagctctcacaaggcttttatgtgacattctttagcacagctagcctgtttttgtgtaaaaggaactcatatgaagaggcaggagattgataatgctggtgcaaatgttttcacaagacggcttgtaacacacccccagtgaagctgcttcgttatgggcccttcaatgaggattcagattcagagtgatgggaacctccgtgactcaggcagctcaaggagaactggcacctcacaaggggaaaacaagtgcatatttctcctgtgtgtcatccttgcagctctggggcttggagccaattgggctgacctcagaattgatgagccagagaaacagcctcccagtcagcagggccgactgtgggccagattttcatgtgggctgtgaagtacagattgtcacatatcttgacgaacattgtgtgtgaggggtcacggcagaaatacatggcagttctaagactgttgaacagaacaaatcctccagcaaatttcctaccagtgtggtcaagttagtgcactaacacgttagaggaccccacatgaaaccagagggaaaatggcagcatgatgtgggagtggtggtaggaatagtagccttctctgatcaagtgcttaagatgtggtaaacactgtatgtattgtctcatttgggtagaaaaatgatgagctttggtgacagacctgggtttgaatcctagttgaattacttacgagctatgagacattggacaagttccttcctctctctgaacctcagtatcctagactgcaaaaagggaataattgggaggactggagataatcaaagcaaaggaactagcacagttctagacatgtaatgaatactcaataagagattatggcaagctgttgtgggtcatggtgatagaagtagcagcaataatagtagtaatattagtatggaaaagttttctgtaaagttaaactcatatgaaggatcaagactttgacttagctctagaattgtagactaaaataagcattgaggtttccatcaccttagaaactttgaacaatgctcactctctgctttaactttagagacaaattttattttcttgtattcctggctcctatctcaggaatgaatctgagattgactttgggttcaggagtcacccttaccaacattgccagcatgacattatcataccctcaaataataacattcagagcttagttgattgctagagctttcttagactttctagatttttaaaatattaattggtcacgtgtattttcaaaacctttttgaaggcagaaaccttatcaccagctgaaagaagcttcaaggagaaatctgttttgagttatatttttccttggggacttgcttatggccgtacataaatatttatctgaactatttcaacaaaccctaaatcatcagtgatccttatgcaaagagtccttttagaagatttctgtatgtcaagaatgccaacagtctctttctaagaacagattccaaggaccagaggcctcttttaaaatagttggaactctttggtggttttcaacatgtcttttgttttcatattctgtatatctgttcacgctattccatctgaatagaattcccttgccagtcctgtctttacctgctgatgttttactcatccttcaaggtctcattcgtgtgacatacagacaagggcaagagaagagcatcccaggcaggagaaacaagagtgggccatagccagaggcaggatatgcagagccattcttggaaggtgagaggtccagtgagaagaaggcagagggtaggatgggggtggtatgaggcaggaagaactattacagggaataaggcaccaagatatgggaggtcttcaaaagtacacaaaatgttttgttgttctataggtcaaaagatgtaaacccatagtgtttgggtagaatatagtctacagacatgttttgtttggcctgaatgttgttaaatttttaaaattagattctaacacataaaaatagatttcatgtcattcggacttctgatagctcttaaaaaacctgagtatctggcagcaaactgctggaagtgagcaggagctatctttcacagatccctacttaaccgcctgcctaattcatggcttggcctgccagcatccgagtttgattctctcccgctgtctgcagagcaccatctaggtagaggaaacgattcagctacagaccctggagccaaactgcctctgttctggcccaggtttgtgtccaactacctcaatgaccttgggcaagtgtgtttctaataatggtacttacctcatgccgccattgtgagaataaaccataggaaacgtttagatgactacctagtacgtagttaagtggacaaaaatgttagctcttattactgtatcccacatgagataataaactttagggctgaaactgtcactcatttctgtagcactcacagaatccagaatttagaatctttggccataactggcataaaatgaaataattgatgaatggacaaatgaatatgtgctccttgagtttttatttctgtgaggtccaaagctaaatttaattactttgttctctagaaatgcttcctatttaccttgagtttgatttgagcatcctagttagttgataaaggagctagctttctcaaaaagtcgaaaatcctaattaaacaagtgaagggagattctattaacaccatgtcatttttctgtgatgcatctaccttcctaactcaaaaataagctccaagtttgggaagatgtttctgtgttttctttaggaagctcacttattggctggtagctgcctatggttaatatctcaaattgagggtcagttgctaggaactaggatgtggtggacttcagcagatatgatgttagaatgcatgtttgacttgggttttcttatatcccatgcctgccatgtgatccacacttcaaggcaaaattttattttattttttttgagatggagtttcgctctatcgccagaccggagtgcagtggcgcaatctcagctcactgcaacctctgcctcccgggtttaaccgattctcctgcctcagcctcctgactagctgggactatagctgtgcaccaccatgaccagctaatttttgtatttttgatagagacggagtttcaccatgttggccaggatggtctcaatctcttgacctcaagtgatccacctgcctcagcttcccaaagtgctgagattgcatgcatgagaaactgtgcccagcctcaaggcaaatatttttgtgcccaatgcatcagacgacgatggacggtttggcatgggaaccaattttcagttttttaacatttcttctatatagctgaagtcacatcatcatccccatcaaggccttcaatgtgatcacctgtggacatgaacgtttatgtttacattaatctatccctaaacagacttgctgtcaacaatgttgctctacaaagttgactagcaaggttaggctcacgtgctctctggaaaacttgaacattttcaaacccattttaatttcgtttgaataaacttcatctaaaactgaatcatgtactcaagattccaaaaaattgctgtttaatttcacctgatagctctcttctttcttataaaaagtcaattttttagtatgatatttttagcatgataatgcctctactttttctaaagaactctcagtctctcacacatggacacgaagaggagaacaacagacactggaacctacttgaggttagaggtcgggaggaggaggaggagcagagaaaatgattattgggtattaagcttagtacctgggtgatggaatcatctgtacaacaaacccccatgacacaagtttacctatataacaaaccggagcatgtactcctggacctaaaataaaagttaaaaaaaaaaaaaatttcagtctcccttagacctctcctttccttccttcccttctgtcctccttctctccctccctcccttccttcttccttttttttctttcttcttgtctctctccttatactatttatatctacgtctctaaagttctggtttctgatccaaaagacaatttcaaataataagaaaatctgatctctaaccatttctccatccctcatccccttcctgcattacccatagaaattcagcacattgctggtacctacgttgtatcctcatcaagctctttattatattcccgctcagaatgagtttctgcccaaaagacctttacatattgagcctattttgaaaagtttgagaaaggaaaatggactcaagtggaaaatattgcaggaaacaaaattttgtaaaaatgaactttatataagagtgcttcattatcaacacataatgaaacctagattataatcctacatgttgaaagaagattaactttgtacattttcacaattttattaacttcactttcttcactgggttataaggaaaacataatggtgtttcagttccaagtatattttgtgaattaaatagcagcttgttcctcactataaaaaacaaatatgccaatatattttccactagcatcgccctggtcaccttaaattaagaagaaactggagtatttgccattaaaagctgttaacagtagtaatgccacaacatctccgtgtgcatcttagtaacttctcagacttgtctccttgatgaatagacaaaacaggaggaggggtgaatttgttctttttatctgaatggtgtaggtggggaagacagagagcaatagagagctctcgtgaaacagagctctagcgactgctgtgcttgggaaattagataataaacagtccctgataccaaaattctaatggcctaagatcaacacagtctggagacgcaggtgggagtggccttcctcgctctgatccagaccctcccgggagagctctttgtgtcaacaagaacagccagtgctcctggccagctcccaggactcagagtggggctatcatttttgtttgctttgcaaatatcttaatgggaagtggttcaacaccacctatgggttaatctgaggggttctgcttggcagctgttagctctgagaaccacatggccgctctcgggtgcagggagtcaggctagctgttaactacccagcgccaggttgaggcatcgtctttgcttattggatttactgactggcaggaagcaccttgttgacttttatttttagtttgttcctcctgggagagcaaggatgttattctcagatccaactgtgcttttttctccaagggagggcagttgtttaaattatttttactagcatgaagcatcctttcacctaagctcattctcagaatctgaaacttcatattaaaagtggtggtgtggtgaaggtggaaggggcattgttgccagaagaaagatttagtatattagcctgcagggagggcaaacagtggaagccacagccttgtcttcacctgggatctaaagaattggatagatagtgaatttctctgctctactgttcccttagtcctctccccctccctctcctccaccccaacatggctttcacttgtcttatcttgacccataggaatgtttccctgggcgacacaaccaagtcatgcctttctggatctgtgtctgctgacattgacacagatgatctctttctttatgctttccttacaggatttcaggcaggtaggatggtttccacaaagcaggttagggaagtacctggagtgatgacagacatgtagacagtttccaaatgccccatttgtaaaaatgcaaaaagttcagatttctctgtaggtcctggaaaaagtgtctagctaccctcaggaatagtgtaacccagcttttaaagccttattctttcctgggggttttctacacctacttgtgggattgtcttgtggttgacaacaagggccctagagtccactagacctgctactacagggtaagaacttcataaacgcacttattttctcaaggcttcagtttcctcatctttaagtggaagatcaaatagcacaatatctacctcaccaagacatgaaagttaaatgaggtaacatatacaaagtatgtagcatctcatttgatgcataaaaagcactcacaaattgtagtgattagaggagttgttgttatctctgaggcatccactttaagtcatccttagtattatgcattttgtactcattttgaagtctgttactcccaaccctttaaaatcatccagtgccaaactatgagtatcaaagtaaatgatgacaaaagagtataatccattgaataaaataagatatcatgagtccatgtggatggatggaaggaaggaaggaaggaagagaagaggctgagctctgacttacaataaaatatgaaataataaaggtagatgaaattaagaaaacagaaaatcatcatttggcaactgcaaaaataattgtttcaggcaataattatgaatggatgctaacactactatgtgaaagtttgaggagtaataaactatttgcatagtctcagagtaagtccccataagaaacttattaattacaaaaggacagtgaagaaacctggcagaaaccaccttaacccaagtgatgaaagttagcatcaccagtaattgaacaaactgacagcatgtgcctcctgttatgatgtattgagaagaagacaacatcacttttgtggatttcttgccaaatgtgcataacctgaatttaatcacgaggaaacagcagacaagtccaaatagagggagcctttacaaaatgaccggcctgtaggctccaaaatgaaacatgacagaagactgagaaactattccagatgaaagggaactaaaagaacgttacctctgaatgcaatagatgatctaggaatttattttgctatagaagatgccattgagacatttggaaaaatctgaatacaatctgtagattggaaaatagtgtcatattaaattctgattttgatcattgtattctggtcatataagaaaatgcccttcctttttgaaaatacacacactgaagtatttagggataaaagagtatcaggtaggctgggcgcagtggctcatgcctgtaatcctagcactttgggaggccaaggtgggcggatcacctggggtcaggagttcgagaccagcctgaccaacatcgtgaaaccccatctctactaaaactacaaaaaaaattagtcaggcatggtggcagatgcctgtaatcccagctactcgggaggctgaggcaggagaatcacttgaacctgggaggtgggggttgcggtgagccaagattgagccattgcactccagtctgggcaacaagagtgaaactctgtctcaaaaaaaaaaaaaaaaaaagagtatcaggtttgtaactgactctcaaatggttcagaaaaaaattatgcatgtttgtatgtgtatatatcaatacagagacagagagaggacaaagcaaatatgtaagtctgctgaggaatatataggattccttatactattcttgcatcttttctattaatataattaaatcaaaataaaaagttgcaataaacaagtcagtgccacttcttgccctttagacagggcagttcatcagccactttctctttagactcctgatctttctccattcacacctaaaagtctattccacgtcatcattgccgtgctcagtgatggtcctcaagcttctcggctgtgacattgctgactagtcagcactcactgcacacaatcttgtttaggcttttcgtttgtaaaagtttctgaaaatgtccgtccctcctctcacgccccctccctcacctgtccttgggccccatcatttagtgccatgtgtgtcatgcacttcattttagcacttcttacttctccttccctggactaagtactactttcagaattaaaagaggaaaactgggttaaatattatcttttgtgggggtggggggggggtgtgcagtggtgaaaagaacatcctccagttacagcatgaaaagggtgtaataaatggtctctgaagtttcctttttctctacaagtctatgccttggcctaattcagtcttaaactgctagaactgtaactcaaaagtagctcaacccacaagttactttaagactccagccgaaggaaaagcacagattctagaaaggcagccacacagatacctcatcattactattctcccttgaagtttccatgtttacggatttgtctttcagatgtgcaaaatcataaacaataagtaaccacattgttaagtatgtgttttatttctaacttctgactatatatgcatctttaatttaattattttaaaaccttgtcttgtgtgtttattttgttctgcccaggagaacaaatgcaatcattttttccttagctcaggcaagagtttttatttatattttgctgatgaagaaggggagaggtgatttgcccaagttagagttgccatatttggcaaataaaaatgcaagatacccacttagatttgaattttctataaacaacaaatagtcttttttgcttaagtatgtcccgttaagtatttgaaaatacttttactaaataattacaaacataccttgttttattcccttttgcttcattacacttcacagatgttgtgttttttacgaactgaaggtttgtgccaccctgtgttgagcaagtctgtttttgccatttctctaacagcatgtgcttacttcatgtctctatgtcagaattttttagccatattttgaaattaaggtatgtacattttttagacataaggctgttgcacacttaatagataatagtgtaaaaattatatgcactgggaagccaaaaaatgtgtgtgactcactttattgtgatatttgctttattgaggaagtctagaacaaaacccacagtatctctgagatatgtttgttgttagtctggagttcaaattcaactgggtgtcctgtttttttgtttgtttgtttgttgagacagggcctcactctgtcacccaggctggagtgcagtggaatgatcttggcttactgtaacctcagccttctgggcttaagtgatcctcccattttagccaccgaagtagctgggactacagatgtgcgccaccacgcctgactaaatttttttgtagaaacaaggtctcactgtgttgcccaggctggtcttgaacttttgagcttaagcagtcctctcatcttggcctcccaaagtgctaggagtacaggcatgagccacccacacccagcctcagtgtcctgtattttatctaacaactctagttcaagtgttttagaactaatatatcatgaatatgtacgcatatagcctgactgtatttcatgaaatatattgctaaatctaccaagtgtttatagcattcctctaacctctacgtgccataacacatagtgttttttgccctttaaggacttttgaaaccgtattcagggatatcaattcctacttatttattaaggtctttattcaaatgtcactttctgtagccactcaatctaaaattgcagaccctgcctccaatactttctatcccccttccctgctttaactttcctctttggcacttacttgtatttaatatgctacatagttacttttctgtttcaatttgtgtctgctacttgaatgtaggttcatgagcagaggactattggatctcctctgctgtatccccagtacttacaatagtaggagacaaatttaaaggtgctcggtaaagacttgggagccgaatgactgatgtctgggagcctgtagaagaccttatattgcatgtgtcatacacattgttcttatacagaatctcaaggagacttgcaccagattagagccttcagtgtggtacgagtgtgtataatcttagtaatagtccatagacacaagataaatagaaggtcaggccagggtttatacctccagatatcattgggcttcatttaatctgcctcctagcaaattttctagaactgaatgttagtagccccaggtatcattcattaagatccttaatagaattgtgtgattatctggaagagtccagtaacaaaattatgctgaggctgagagcatgggctccgggtcaaccagatcaggatttgtatctggttatgacctatgttactcaaatagcccaagcttgggtttcctggtctgtgaattgggaacactgggggacctctgctgctagcactgtcatgggatgaaatggatagtctagccaagtcctcagcacagtgcctgatggaaaggaagctgcttccatcaccgtcacccaggccacaccacaaattccacctgagctcacataaagctcagctgttctagccatgctgtggccctcagcccacggctctgtatcccttcagatcacaatacccttctccactactgcgtctcttgttttatccctgaactttctctcagctcccttggttgctgacaaataactgaaataagctttatgggcagctgtcagttgagtgtccttttttccaataaagcaagcattctcagcagaatgaagaaaagccttctgctcctaccttagacttttacacagtgacagctgcctgcagtaaagtagtgaaggagggaaaagaaaacaaatgagaatgcaaggactggcaaattaagactgtatgggctcacggttggggaaaagcaatgaggcaaacaaatatgatcacatttaaagggctcagtgggatttgagaaattagcataagtgcataaatctaactactgctaacttagagcaatggcattatgagacagtcatcagcctttttgagcccttctgatgaatttatccttgagccatgttctaaaacttaaaataattgtgtgctttagagcaaacaaatatccatatatttagatataacttgcatattcaactcattcagtaatgattagggtgggatgcagtgcatgcattcagaattgttccaaaagttactgggtatccaaacctgatgagaaaaagtaatacaaaaggtgtgaagtttattccttcttgtttcccttattttcctgcaataatggtgatcttattgtgtactgttactgtttctcctttcctatgctctttgtatttccttcatatcacacattaaagcccaggaataatgtttttcctctttagaaatcaagaagtacaaattaaaataatagtgaggcatattttgcaaagagataagcaaagtatctcttctctgatgtcattccttaaatatcttaatttacctttgtaatttgaatttactgaaaccgtttctgaagatgtgtatgttttctattatctcttatggtaataacttccataatgaaagttatatgacttgtttatctgaaacttgcctccctcaagattcttggggcccctactatttaaaagtatgctggtctcggctgggcgtggtggctcacgcctgtaatcccagcactttgggagtctgaggcaggtgaatcacgaggtcaggcattcaagaccagcctggccaacatagtgaaaccccatctctactaaaaatacaaaaaattagccgggcgtggtggtgggcgcttgtaatcccagttacttgggaggctgaggcaggagaatcgcttgaacctggagggtggatgttgcagtgagccgagatcgtgccactgcgctccagcccgggtgacagtgcgagactctgtctcaaaaaaaaaaaaaaacaaaaaacaaaaagtatcctggtctcaggaggctgagataagaggatcacctgagcctgagaggttgaggctgcagtgagccatgatctcaccactgtactccatcctgggtgacagagttagaccctgtctcaaaaataataattctggtctgatcatatcgtctgcagagtggttttactgctgcttcttgggaacaagaaattgaccttctcttattaagagctctttgatttttttttttttttttttttttttttttttttggtggggaagctggagtgcagtggcacaatcatagctcactgcagcctcgacctccctgggcccagatgatcctcccaccccagcttcctgagtagctgggactacaagggcatgccaccctgtctggctagtttttgtattttttgtagagacagggtttccccatgttccccaggctaatctctaactcctagattcaaggaatcttcccacctcaacctcccaaagtgttgggattacaggcttgagccaccacgcccagccaagagctctttggtttttgttcaaagttatcaaagaggtggaaacaaattacttggctatgctgattgcctttcttttggggctaccaaatgagacacaaatttactaggagaaatactcccaaatttagagacaatggaaagctaacaaaaatcaaccaacattgaattagctattttgaaattagagtatgctttcaagcgtgaacgaataaatggatatctcagtttctctccaagccattctaacttataattgataaaagataatcttgaaaactttatcaaaattaataaaaagtacacaaagaaacaagtaaaatttagaaaatggagaatctgaggggagccagtgtgtctcaacgcctatccaagcaaaaaggtactgattctaaccctaaaatagaaaaagccagttactaggcaagcttgactgatcagatacattctcaaagagcaccctgcttcttttgctttaattctaatgtgtaatttagtctccagagtgtatcaaccaactagagaggggaaaagtatagtccagatcataccattcattataaaatcacactcgcattgtacatttcaaatatgactcttttgagattggttattgcaactcagctctccccaaaatcatcatccctcaatgaactgacaaattgaattttggagcctgtgaagctgaggcccagtccctggaccatggtgacttcacctagtgccaccggcgcagcgtgacagagccagctggcctcatggatctctgctgcagaagaagggagatgctgggtattctcagcagccagctactcaggagccagccttcaccttgcccctcatccactcacactgggatccggatttaagaagaaggaattagatgtgagttttgtctgggggctttttcaggacagatgcccagcagaagggttctcaacggtgactgagagtttccgtctcccctagaacccacagttcaatgaactgacttcagcgaagcggtcgagccctggaggcaatctgtttgagactttagttatgcttccaagacgccaatggagccctagaaatatgtgatgaattatacaaagagggacaactactttctattcaccttattttgatagccatatacactgcttctgcccatttagcttatgatttccagcagaggccgaggacagtgttatttgttaaaaaaaatttcctgtggattcagaaaacaatatcacacttcataaatgaattaattccttaatatcgtcccataccaattcatagtcaaaatttcccaattgttctaagaatgtcctttgcacatgtttatccaggccaggatccgatctagaatgttacagtgcatcaagttgttatttcatctacatttcttttgatacagaatagtcacttttttcagaatactgactttttcagaggatcgagccataaaataggattatctcataaaatagctcaccttctgtatttagctgcttgcttcctgtggtcttatccagcttgtccctctatgccctatgctttgcgtagactgtaagttagatctaaagacttaatccgatttaagttacatgtttttgaccaaaaggaaaaaatacatcctgggtgatattacatacttcatgttgcctcacattacaagacaatgttgtcgtggtgttagtggtgttaaaattgagcaccggattaaaatactgaccttctgatttctccagtgtacattgcctctcttgtgaaatgaaagaaggaggttagccacctgtatggtggtactttggctccatatgaatgtcctcttccctattaacagtttgtctatgattttatcagcaattaataattctttttatttatttatttttttttttttgagatagggtctcactccggctgtccaggctggagtgcagtggtgcgatcttggctcagtgtagcctcgacctccagggctcaggtaatgctcccacctcagcctcctgagtagctgggactacgggtgcacatcactatggcccggctagttttttgtatttttaatagagacagggtttcaccatgttgcccaggctagtctccaactcctgaactcaaacattccacctgcctcaacctcccgaagtgctaggataccaggtgtgagccatcacacccagcaacaattgataattttggcctgataatttccctctggcatcaccttttccatagtcaatataccatagtcttatggtacactgcttaccagctgtggtttgaagcaaatcactggcttcttgatgcttaattcctttatctgtaaaaataggttattttaggaagcagaggcaggaggatcgcttgaggccaggagttcgagaccagcctgtgcaatatagtgagacttcatctctccaaataataaaaaattagccaggtgtggtggtagcacatgcctgtagtcccacctacttcggagtctgcagcgggaggatcacttgagcccaggagttcgaggctgcagtgagccatgatcatgtcactgcactctagcctgggcaacagagtgcgattctatctcaaaaaaaaaagaaccaatccacatggctgtcagcagtatgtaacatgctttgcctggtgcctggtggtatgtatccatgcaataagcattggcttttttttctttctttttaaaaaatattttaaaaattcaattaaatagagacagggtcttgctatattgcccaagctaatcttgaactcctgggctcaagcagttctcccacctccacctccccagtagctgggattgtaagcttgagccatggctttttgttattattgtgctttttcttattttggtagtgacggattgcagagcattatccagtctcatgtccctaaggcaaaaacaaaaaacaacaaaaaaaacaaaaaaacagcaacaacaacaacaacaactctataaaggagttgaggaagttagattttttaagaaaactgacttgtaccatcttcttaaaagcaaggtgtgttctaagaatcagtagtgcctcaacatggtacagaggagaagggtccattgttaaaataatgtctagaagatgtttccaattcttttcctttcttggagtctcattgaacatattattaaattaaagttgccggaaagcctctcgggaaagaaacctggcttgtaggctaatctagtattttctaatttatttgcctgtagacactactccctgacctctgccgctgacttttcttaaacacacacaaacattacattgagctgccttcgattcttccaaaggcttgaatgaagagggaatcaaacagataagctgactccctgtggagagttgggaggtgtctgccattggctttggattctgaaaagccacacaagctagaggagttgtcaagaggttcattttttgaggggtcaggaaaggcataaattaggggtctggcagtaattcaacagctaaactctctttcttagactttctcctagaggatcttagaatccacccatcctataggtgtgtcacagctactgggacttgcctaggccagacaggagtgagtcctttgggccaatgcttagatactgaagggtatagaatatattatggttcagaggaagagcagaggatttggagtcagacaaacacgggtgaatgccttagctctaccaggtatttaccatgatacctgggaaaatctcttaacctctctgaacctctttgtttatctgtatgatagatacaattaaagtacttagaccaaatggttgtgaagctttcttaaatatttaaaagcattttttttaaatgaagtagtatataaatgatagttaatttaattttaatagtaagagtattcttactgatctacatggccccgcattttgtggattgactaatcattgttttatttattcaaatggtcaatatttactgagcattttctatgtaccaggcactgggtaggtgcttacacagagcgtgaaatagagcagatccagtccctgacttaatgtagcttacattccattgtgggagacatatgataagcaaatatacacacaaataaatatagaattatagtcccctccttccaggtactgatgtggtaatttttaaatgggcatattgcttataatatatattttgaaggtaatatccacaaataaatatacggaaatgaatttgtcagcttaagtaaagaataagattattaatatagaactggaagagaccttaggaataatttatctcaatctcctcattttatagatgaggaaaactaggaccccgaatactacagaaacttacccaaagtcacatgtttgttgtgtcatgtgtgtcacatgtgtgcgtgtgtgtgaggcaggggtcagaacacagatttcccttctttactcagtgctttccactctgctggttccatctgaaaggcattatgagtggctcctattttatctgtgtgttataagtacactcttatacaatgtgttctgattatcaaaaattggggacccagaccaattgatttttccaaactttgttccatgaagcattaggattttattagatgttaataggttatcactttaagcttcttggtcaaattactgttggaactttatctttactatagagatccataaatgtatattgtaattttaaaagattattcctgcagtaaggaaacctttcaaactacgcccaacctaacattccccaaacttacttgattacggaatccattttaagttctgtaactgtgaatgtgattcatgtgctgtgcaggaagtgtagccttagcatccatttagttggcttcttggtaaaggttgtggaagcccaatagagctcgctaaaccaaagccaatcacacaactttaaaaggagcagtttcttgggtcttaggaattcaggcagactgtggatgtgctgtaacatgtaggagcaacacctagtaggactcattttcttaaggtgaccatgtccttttaaccaaggactgaaatgggaaaccatggaagcataaaaagtatgttttgatatatctttgaagaaaaacagtcctctctaagtttttctattattattttcaagtcttttaaaattattattattgttatcttttcaggcattcacaagcccagagttctccaaaagggtgcgatatcttcgcaggacatgcaaacaaggtagctggatatcttgattccaaagtaaatgtgtatcactccttcagactcatccaagttcataggcatgaagcttgtctgcggctgcgtggttggaccatccaaacttgaaactgttagtgatattttgaagtctttgagacaaaagcccagcttgctgaagaactttggttcagtagagagacagggaggtacaggggagagagaatcaaaagcctggaaatttgctgctgagaataaatgttagctgctccctgaggtgatttgtctgtgcactccactctctacagatgttagagcctctttttgagtaaggacccgaggttctttggtagcactttgatatcctgctcgaattcaatatgtgaaatggaggcgtctctctgtgacttggagcccacagcaggctttgaagtctgatccaatttttgctgcctactatttgatgttgaaaggatgaaatgaagaaaatgtacagtttttgccagtaactctgctgagcatatgtaagattaaaaaaacaaaatcctttggatgatgtacttagaaatgttaagcagattaataccttcctataggttttcttttttctttcttagagataaaaaataagtataggtgaaaatcagcacatagctgttttatattctggactataattaatttaacaggaagctaggttgactcgttctgaggaagaaatgaatgaagcaaaagatgttaagacttggcttctaattgccccaaggagaggacctccattcaattctatgtaagatgggagcaacttacaaatgattccagtatacttagcctcttgcttttagtcaggtttaagtgccccttcattaaatagaagccatgtccttaaggctgtttcatcagaggataagaataatatttctcttactgggtttttctgaagcactcggtttctgggactgatttgctgtcttctcggatatgccatcctgctccagatcagcaaggattgagtctctggggagcccctcaaaagcctggtaagaagaacgttttgaattgcatgcggcttctaccatttgcatgtttgtgtactttttagtgtgttgtttgggcaggactcaattagatagtaatatgaccaaatgttggcaaaaagttttgggaagccatacatgctggatgtaaaacttgtattaaaggtagcagtttaccatgtacccatgtcatttaagacaatgaatatcaaagtccatgcttttccatttacttaaccttaaactaggaaactgttctaaaatttcattttattaaagggaagataaacagctgaccagcttttagtggagcggatcacgcagggtcgaaatctaggagttgataaagaatatggatttagaaagtagttctgcccttttggcaacatggccattctttgagcaagtagacagaaatgcctttgggacacaactctttctggctcgttttctaaatgtcttgctacagaatatagtaaaagtcagtttcaggtttgcatgcagctaaaaccagtgcttctggaaaataaaatagaaacataattgtaagaaatatttacaagctagaagatactaaggactacgtgaaccattccaagaaaagaaatgctcctgatgttacacttaatgtcaacctcatctatttttctgaaatataaagtaatttctcagatctcttcaattttcttcttagcctgtttttcggtgacaaagtagcacagtatgaagtgggaaatgcataataaatgtgtcatgacttcagtctatatggatcttaaactcttggagagagacaagaggatgggtccattatagcagaaccttttaaatggacatgtagtaaatgataaacccgacaaaggaaatattttcctcataggcagacagtattcaggaataaggccacaatgaagtgggggtaaaagtagtacaaaaaaagaggagagaatttaggggaaaaacagtataatggagcaaaattcattatgcgagagtttggttggtacttttctctatccaaacagacagtctctgtattttaattggagtgtttagatcatttatatttaatgtgattattgatatgttttggtttaaatctatcatcttgctatttattttctatttgtcctatctagtttttgttctctcttggtattctatttttaaatagatgtaattcctaaaaacaaaactttgaagtacggttgaatagctaaaccatactgacaggttctggcatcagacctgcctggattcaaatctctgctctcctgtgttaatcaagttacatagcaactccttaccttagtacctacacatgtaaagtgagggaaatagtaatgcatatctgagtggttttacttaggattaaatgagctagtgtaagtaaaaggcatagcatagtgtctggctcatagtaagtgtttagtaaatgtcaattgctgttacggtaattattgttattgacattatataaatgcaaacgtaatctatgaacatgaatactaggtagagaaataaagttctttttgtaaggcattaagttttggtgtgatagttcaggggaagtaaaaatacattgcattttgaattaatatttattaaaaagaaaagagacttgttggattacaataatctttcccattctttaggaaagtatcttaaaaagtcaaatttattaataagttacacatctgatttgctataaatggctcatatgcactttctttctagagttgtctcttccttccagtctaaatgattttctattgggtctgccaccatcaccattacttccccttacactcttataaacagcatcctaagtatttttcctgcctccattcttctgctttagcttctcttatgccaacagaaacctaagatttctaaagcaaaatcctaatcatgaccttctctccctccatactcttcagtgtctccctagtatcccagcatgaccttcaaggctttctctgttctggtcctaatcttcttttctagctctaacttccactgctctctctttttcattctgtgcttcagaatctccaaactattctctattctccgaacatgcctggtgtgttctttccctcctctgtgactgttcatgctgcctcttctgctccacatgtccttcttcctcgtttacttttcaaaatcctctccattcttcaaggtccacaatggctccctactcttttactctttcttataatacttatcacatcctgctttgtgttatagttactttaatgcatctactagatttaaaactctctagaatcatgtcttcccatttatgagttctctcctcacaacctagcctaggtctcgaattgaattcttgaacatccaaagtggtgatgaaatataatggaagcaagaatgaaatgaaactctacctaagtaagcaatcagagaaaagttttaaaatgtatttctaacaatcctagaacaaagtaaatgtttctgaggcaagctccaaatagatatagtgtactagtggaagaaattaaaataatccaagctatttcattttgttgctattgctgttttgggcaggagaagcaaaggaagtttagacatgaagacgtgagaaaacactatatgtaaatcgaattccccttgatcttagaaaacgacaaagatgaagaacaaattagtttttccgtttcgcatatattatcagttgtagaaacaagaatatattatttaagcaacatttttagcaaattatacctttgtgtttcattctgtgctttaaatgacccattattttaacccatgtttttgtggaaggctgaatgagaacattgtgaccttttcagtttaaaaaaacactaacatccagaaggtttgccttctaacttgcagtgaggcctaacttcgttattctatgaaggggtctggtgaggtgagagtgagaggcagggaataaatctaaagttactccatctcaagctcagcttagagcagccactcaaataagtctctaaatatggggcttaaacaaggctgtcttcagagtataagaagtgtccctggcacggcgtggtggctcacgcctgtaatcccagcactttgggaggccgaggcgggcagatcacgaggtcaggagatggagaccatcctggctaacacagtgaaaccccgtctctactaaaaatacaaaaaaaaaaaaaaaaaatagccgggcatggtggcaggcacctgtaatcccagctactggggaggctgaggcgggagaatggcgtgaacctgggaggcggagcttgcagtgagccgagatcgcgccactgtactccagcctgggcgacagagcaagactctgtctcaaaaaaaaaaaaaaagaagtgtccctaaactggcccatgtggtccggcttattgctcacattaagagaaaagcacaatatacccgggaagtgcataattctagtcacttggtcactaatccaagcagtgaaattatttaataggactgacagcaatgtatacagacctcatctggttttactaatgcaaatggttatactttaggcatttgttcttctacttatatttatttattcaaaaaataattattaacgctatgtgccaggaactgagcagtatttctcaaaacttttataaaaggccagtttttggttggttgttttccatttcaccacagtctgatacttttgtggaatacaataaaaatgaattactaacaaaataatcatgcacttggatgttgtgtcaatatcaaaaccctgtccacatgatgctacactctagcagagggagatagacaataaacattaagcagacaagtaagtcaattatgtgggatgttagaagggtgaagagttacggggagaaaatacagcagcaagggtgataaggggtggcccaggcgtagagggtgagtttgggtggttgtatttttaaacagggtggcttcattaagaatgtgaggtttgtagccgggcgtggtggcaggcgcctgtagtcccagctactcggaagactgaggcaggagaatggtgtgaacccgggaggccgtgcttgcagtgagccaagatcgcgccactgcactccagcctgggaaacagagcaagactccgtctcaaaaaaaaaaaaaaaaaaaaaaaaaaaaagaatgtgaggtttgagtaaaggcttgagggtggtgagccagttcaccatgtaaatatctaagagaagagcattcctggcagaagaccatgataaaggcctggaggagagaatgtgaatggactatatgaagagtagaagtccctgtattggagctaagagagcaaaaagtagagtcataggaaatgaggagccagatagtgcaggttcgtactgcttaatgtcctaacaaacatcctaggaatctagatacaatgaagattctcattcagcaggtctgagtggctctgagattctgcagcactaatgagcttgcaggtggctctgatattgtcggtctgaggttcactttatgagtagtgagggtttagtctcagtgaaatgggaagccagtgagtgggagagtggcatgatctgggttatgattttaacaataactccagttttggagttgagaaccaactagacatcatcaagaaatgagatagtctgtgtaagtacattttctctacagctgaaactctctcaaacctaaaattacctttcatattgagtgcacaaacacaattctccttattctttgtatctaggggcatgattattaacagcagttatcacattgggctgtaatgcagagcaatcctcagagaccaatatgaaatggggccacctacccttgcagtaaatgacccttgaccattatgatttttagttaatgtgccagattctctgtttaatttttcctctctcaacacaaagctgatgtttcttgctgttgttaatgagctgactttttgtgacatacttttcttctccttcttcctttttcatctttgctatggtctaaaaaacaggttttaagcattttttttaggcagtaaaagaagtgggtttgagagggagatctgagaaaatcccctatgaataaaagaacaggaactcttatgtatgtagtacctatattaggtaccatgccaggccctttacttacattttcttaatgtaaagtacacaagctttagtttaaccttgtgacctgtgcctgttaaagaaccctcactacctgcccttgggttttcttttatacctcacctaagaggtacctctgttctgggttttcttcctgtctacagggagtataccttaatcacgtttctttttgaaggtcaaaagtagcaagcagtattctactggcctcctgagggggtcacagttggcaaagcacactgttgggatgtagtagagccaccagagagcatgtggaacctggcatcaggcattagtgattgatttcgggtctttcatggcctgtctagccacagctcctgagcaaatcacaccactttctttcacttagcagcttctttaatgccatctacttcattattttcctttacctttccagttgctctcattactaaattttataaattttatagtttttggcagcaattcagctatcagaaagcaaactcaggctgtattttattcttggaaactttgatccttaaggtgaccaaatatctcaactttcctgtgacagaaatgttttccaaaatgtgggattttcagtgcttacaccaggacagtcccaggcaaacagatgagtcggtcaccctgtaataatacaggaaattgagtttgatttaggcaagatcactatatcgggcaagactatgcctcagatccatgcaacagaatcacttcacactggccgcctgtgtttggaagggagcgcaagcagcttgccagacagcaatgctatgatcataaagggctaagatgtctcccatttgatagggaaagcatgttcctacaacagagtctcaaaggccgcataatctccctcaggaaggcacgtggaaatcagacactaaacaaaggcaaggctactgggcatctctgtcccatacccaaattcatgactgaatgtcacacacaagactgtattcatttatgggtagtctctgaggttctgaatccctgctctttttggctccctcaggctgaaaacatcttttcttcttgtctggatgccattgaattcaccttaaaccctcaccagtaaaacttggtaaagtcttatgtgaggacttttctcagtaaaatgacaaaggaattacaggtatagaattgttattgctagcatgtgaggttagaaaaacacctcaaatgaagggatctttttagacaaatggctctcaaacttcactgtgctctccagaatcacctagaatgctagttaagacagactgctgaacccactgcatagtttccaattctgtgtgggatggaggcggggattcgtattgttatcaagtttccagaggataagatgctgctggtctggggacttccctttgaaaatcactgctctggacattacctatctctgtgacacaacattgaatcagagaaagtgggctttatatatgtggctttctcctcattcattcaacaaacatttattgagcacctactatatgtcaaccacagggccaggaaatgaaataagacacttaagagactaatacgattataatatcttggtctttgcagctgttgttttccaaagctagtctggtgacatgttgagtgtcctcctgtatctcaagtgatctcattaaattctcgggaagttgtcaagaacaaagttacatttacttttagctttgctgtgcaggaagagggtgggagtgttccagacttctaaatagtctataaagtatatcattttctaaaattattaggaatgactgcctttattgtttgtttgtttttgtgagacagagtcttgctctgtcacccaggctgcagtgcggtggcatgatctcacctcactgcaacctctgcctcctggattcaagcttttctcatgcctcagcctcctaagtaactgggattacaggcctgagccaccacacctggcttttttttgtatttttttgtagagacaggatttcactatgctgcccagcctggtcttgaattcctggactcaagtcatccatctgcctcagcctctcagaatgctgggattacaggcatgagccaccacacccagccagaaattattgctgttaaaggttatttccagattataaactatgctacttctgctaacctggctgtagtatattctcccacatggcaaaattactctaagccccaccagatctgaatgttttcatatatatttaatttaatttaatttaattatttatttatttatttatttatttatttatttatttttaggtggagtcttactctgccacacaggctggagtgcagtggtgtggtctcagctcactgcagcctccacctcctgggttcatgtgattcgttcttacatatttctaatacatatgtcattgccataatgtttgttccctgactttttgcaaaaaaaaaaaaaaaaaaaaaaaaaaaaatctaggcaaggccaacataaggaagtgtacagtttgaggcttgtgggcatgaggacaaagggatggaagaagaaagaagacagattatagttgtcttaatccccaatccaatttctaattaagcttaatttatattaatcatatactttttctgttttgcttaagtgactgatatggtttagctctgtgtccccacccaaatctcatgttgaattgtaatcctcagtgttgggggagggacctggtgggaggtgattggatcattgaggtggggatttcccccttgctgttctcatgattgtgaatgagttcttgtgagatctggttgtttaaaagtgtgtagcacttcccccttctctctctcctgctgccatgtgaagatgtgctttcttccccttcccccttctgccatgattttaaagcttcctgaagcctctccagtcatgcctcctgtacaccctgtggaactgtgagccaattaaacctcttttctttataagttacccagtctcagtctcaggtagttttttatagcagcatgagaatggactaatacagaaaattggtaccaggagtggggtattgctataaaggtattaccataaagataactgaaaatgtagaagcaactttggaactgggtaatgggcagaggtaggaacagtttggagggatcagaagacaggaaggtgagggaaagtttggaacttcctagagacttgttgaagggttgtgaccaaaatgctgatagtgatatggacagtgaagtccaggctgaggtggcttcagatagagatgagaaacttactgggagctgcagtaaaggtcactcttgctatgcttatcaaagagactggtggcattgtgtctctagagatctgtggaactttgaacttgagagagatgatttaggatatctggtagaagaaatttctaagcagcaaagcattcaagaggggtcctggctgcttccaaaagtctacactcatttacataaacaaagaaatgacctgaaactagaacgtttatttaaaagggaagcagagcataaaagtttggaaaatttgcagcccaatcatgtggttgtaaagaaaaacacattttctgtggaagaattcaaggctgcagaaatttgtatgagtaaagaggacctgaatgttaatagccaaaacaatggaaaaaaactcctccggggcatttcagagaccttcatggcagcccctcccatcaaaggcctgcaggcttagagggaaaaatggtttcctgggctgggcccagggtcccactgctctgtgcagcctcaggacatggtgccctgcatcccagccgatctagcttcagctgtggctaaaaggggccaaggtactgctcaagccattgcttcaagccccaagccttggtggcttccacgtggtgttgggcctgtgggtgcacaaaaacaagagttgagacttagaagcctctgcctagatttcagaggatgtatggaaacacctggatgtccaagcagaagtctgctgcaattgcagagcctcatggagaacctctaatagggcagtgcagaggagaaatgtggggttggagcccccacacagagtccccactggagtactgcctagtggagctttgagaagagggttactgtcctccagaccccaaatggtagatctaccaataccttgcactatgtgcctagaaaagctgcaggcactcaatgccagcctgtgaaagcagccaaacttgcagaaccaaaacgctgagctgcccaaagccttgggagcccacctcttgcatcagtgtggcctggatatgagacatggagtcaaaggatattattttgaacctttaagatttaatgactaccctgctgggtttcagatttgcatggggcctatagccactttattttgtccaatttcttccttttggaatgggagcatttacccaatgcctgtacccccattgtatcttagaagtaactaacctgtttttggttttacaggcttataggtggaagggacttgccttgcctcagataagactttggacttggacttttgggttaatgctggaatgagttaagactttgggggactcttgggaaggcatgattggttttgaaatgtgagaaggacatgagatttgggagaggttggggtggaataatatggtttagctctgcatcgccacccaaatctcatgttgaattgtaatccccagtgttgggagagagacctggtgggaggtgattggatcatgggggcggatttcccccttgctgttctcatgatagtgagtgagttctcacaagatctgattgtttaaaagtaagcagcacttcccccttccctctgtcctgctgacatgtgaaaacgtgcttgctttccctttaccttctgccagaactgtaagttttctgaggcctccccaatcatgcctcctgtacagattatggaactgtgagtcaatttcacctcttttctttataaactaccgagtcttgggtggttctttatagcaatgtgagaatggacaaatacagagacttttctcatttttactagatctgggtttttggtttctttgtttttgttttgctttgttttgtaattttgaagaataggaacagggtgctttggacatcagttatagtcctagtagtttacctcaactgagggctctgttcaaaactggtgctctctgaaggaactctgtggatacctaccaagattgatcatagtgccccatttcccttgaaagaatcaggatgaaaaggaagaacaagggatgtactccacaaaggtcagtgcttttctccaccctcagccagctgaatcaatagcaagattctgactctattggaggagctgaggctagaggagtctagaggcggctggaggggaaagtggccacagatgtgagagtggcagatacaagccgcagaggtcacatgccaggccaccattcctgaggccacatacctcaggaaaaacctttcacagcctgttctcattcctgcgactcattaaagcacattacagaattgaacagtttttgaacatcatttcttcttagattgttgctgcaaacatagctgtgaaaagttcttgctaaacttttccggtgctttcctgagttcgttaggtcatgatgcactttttgccaatgccaagttaggttttggcgttggcccaggacatcaggagtgcagatgccaaacaacacaaggcgggtggtgtgtgagtcaagttagggtatttggcttccaagattggatgttgatggcatggctgtaaaatgtgcctagagaaaatttatttttaaattcttttcttatttgatataattgaaacaacacatactctcaagactgccctgttaaccacagctgcctagtttatttcattttaaaggattctttcaactttaaaatcaaacatacaattgtttaatggtagggttgtagtgatttttcttctttttatgtttgtttgttttctaagattgagaataataaatttgtttgcgttttaaaaagttaatagagtttacttatttgagtaatttttggcttacagaaatattgagcttaaagtacaaaattcttacataccctttctcctctccttttctccctgtttcttctataattaacatcttgtattagcatggttcatttattacaattgatgagcccatattgatacactattattattattacattagagttcactgtttgtgctgtacgttctgtgagctttgacaaatgcgtaatgacctgtattcatcatgacagtatcatacagaataatttcactgacctaaaaatcccatctctacctccttattcctccctccccacaagcccctggcaaccactatttgtttttttatttatttacttattgattttagtgcctccatagctttgcctttttcagaatgtcatatagttggaatcatacagtatatagccatttctgattgacttctttcactttagcaatatgtacttaagaggccaggtgtggtggtttacacctgtaatcccagcactttgggaggctgaggtgggaggattgcctgaggccaagagtttaagaccagcctggacaacacagcaacaccctgtctctacaaaaaatttaaatattagccaagtgttttggtgcatgtctatattcctagctacatggaaggctgaggtagaaagatcacttgagcccaggaggtcgagggtgcagtgagctatgatggtaccactgcactccagcctaggcagtagagcaagatcctatctctaaaataataataataatatgcatttaagattcctccatgtcggctgggtgtggtggctcatgcttgtaatcccagcactttgggaggccaagacaggtggatcacttgaggtcaggagttctagaccagcctgagaaacatgacgaaacactgtctctactaaaagtacaaaaattagctgggcgtaatagcacacgcctgtaatcccagctactcaggaggctgaggcaggagaatcacttgaacctgggaggcagaggttgcagtgagccgagatcacgccattgaactccagcctgggcaacagaccaagactctgtctagaaaaaaaaaaaaagattccttcatgtcttgtcatggcttgatagcttaatatcttggttgcttccaagtttggacaattatgagtgaacctaccataaacatttgtgttcaggttttggtgtggatgtaactttttaattcatttgagttaatacctaggagcatgattactggattgtgtggtaagagtatgtttagctttgcaagaaactgccaaactgtcttccaaactggctttaccattttgcatttccttcagcaatgagtgagagttcctgttgctctgcatcattgtcagcctttggggtcgtcagtatcttggatttttacttttttttttttgagacagagtttagctcttgttgcccaagctggagtacaatggcacgatcttggctcactgcaacttctgcctcccggactcaagtgattctcctgcctcagcttcccaagtagctgggattacaggcatgtgtcaccacgtctggctaattttttgtatttcagtagaaacggggtttcaccatgttagccaggctggtctcgaactcctgacctcaggtgctccacctgccttggcctcccaaagtgctgggattacaggcgtgagccactgcacctggccagattttgacattttaatagttgtgtagtcacatctcattattttaatttgcaattcactgataacatgatattaagcatcttttcacagcttatttctttcacatgcttatttgacatctgtgcgtcttatttggtgaggtatctattcagattttttgaccattttaaaattgcattgtttgttttcctattcttgagttttaagagttctttgtatattttggatacagtcctacgttagatacgtgtttttttttgtttttctttccaacttttcttttaggttcaaagggtatgtctgcagggttttttatttttatttttatttttttttgagacggagtctcgctctgtcgcccaggctggagtgcagtggcacgatctcggctcactgcaagctccgcctcctgggttcacgccattcttctgcctcagcttccggagttgctgggactacaggcgcccaccaccatgcccagctaatttcttgtatttttagtagagatggggtttcactgtgttagccaggatggtctccatctcctgacctcgtgatccgcccgcctctgcctcccaaagtgctatttatgtttgctaagttactaaaactcctggaaaaactagaaaaactcaggttgtctgctaaaacagtatttagcaagagatcagtttgttggtttaaatttcagagagggctgggagataataaaatatacctttattcctcattcattaggatatttgtccagcagatgttacttgagcacccactaaatggcagacactatgtttgatataatacagggagcaagagccaggcttgctcttgtgaaatttatattctgagagagatggacaaataaatttgaaaacaagtctgctttgactagggtgttgataggggtgagcacaggagctgtgggagctccaacggtgatatgtggtctccaggaaaggttcagataagcttactccaaaactcagacctgcagcgaagagtcagaaaagatgtttccagccgtctgcccattctttttccacacggggagaagctcacatgtgagagatacaagatcaaggtggttgtttattttgttttgcacccccagcccccatccttggttatttttggttttgccttttaaaaaattctgaaatgtaacatgcttacagaaaaaaaaaattcttaaaacggaggccagacaccgtggctcatgcctgtaatcccaacactttgggagaccaaggcgggcggatcacaaggtcaggagatcaagaccatcctggctaacacggtgaaatcccatctctactacaaatacaaaaaattagccgagcatggtggcgggcgcctgtggtcccagctactcaggaggctgaggcaggagaatggtgtgaacccgggaggcggagcttgcggtgagctgagatcgtaccactgtactccagcctggtacagacagagtgagactctgtctccaaaaaaaaaaaaatgcttaaaacgaaaatggacagtataataaattattataatgcaagcaccatgtgagcacaaccgagatcacaaaacagtccttgccagtgccacagaagccatcagcatgccctttcaggattatgactctcttcctgcatcctacaggtaaccacctaaatatgtgtctctaaatattatagcttaattttgcctgtttttaaactttgcacagctggaaccacatagcatatattctttgacttctagctttttctcttttttcccttaacattatattttaaagattcacttgtatattttcgttactgtatagtatcccattttaggatgagagcacactttatgcattcatgtttctgttgatgggcatctgggttgtttctagtttggaacccttacaaagaagagatgttcatggatgatggtcccatacccttggcagggtggcaaagctggctttggagtcagtcaaacttaaatttacatcccatctatgccactctaatagctttgtgactttggtcaagttaacttaatctccctatatccctctttcctcatctccaaaataggaatagtaacagtacctacgtcatagggtatagatgtaaggtgcttaacacactacttcacatgtagtaagcactcaacaaaaatttggtgctgcatggagttattcttgttactcataggaatatttcatttttatttgaggaagttttctacagagttaatatggcctaacctatccagatttaagattgtagaagctttcaaggtcttttgttcaactctcattttatagatgaaaagactgcatattagttggccaacccagagctagaacccaacccagagctgggctttagggagacatagagtcagtagtacctctggatcagcattctggcacaggctattcttaagggctcattggatggccattttagcttcttaaatgtattctcctctttgttctttaaataaatgggaaaatagaagccttaaggggttgaccagttagctctatatttggctgtagactgtaaagtctattacattatatccaagttgtttgattatttattcattggtcagaatttagggtttcaagggctctatcctaattaggccaaaagatcagagagcaaaataaggcacataaagccatgcctgggggattattggcattaggtagaggtgttttgtttagtttggactgcagttgaatttggattaaaaatacttgcaattttttaaaaagaacagatatatctcttattaaacaaactataaatatagtttggataatgacgggagggagaaattcaacataaactggatattaaatgagtctgtaatttttctccctaccaagaacaattcacaatgacttcctgacctcccactttcaaatcatgcactctatcctagactagagctttgcctgagcactgcccaccaccatcacccccacactcactcctccggtcccacattgtcccctctttccagtgttttgctgatatttaaggtttttattacactaaaattccctgttctgtgatctgtgttcctgggttcctaagaatgtgtgtgtgtttgtctgtgtgtgtgtgatgctctggaagctttgaggggattctgggtcaggacttatccaaaaataagactccagattattagcttactacatgtagaataatgcctggtacatagtaagcatctaataaagtttagctgctgctactgctatttcttactcttccattgcgaatcacttttgaaagtacctaatttccaagtttagcaactcctttcttctttccactcaaattatcaagtcttctggagtgcgctacaatttctaaaaaactacacttgttttccctcgatactaccacaagtctcaagagtatatcaccttgaatctttactgcatttgagtgggaccaatttgttggtattttctgtgtctggcagtttgtgtaatgggagggagttgtttcattaatccacctaaatggtttcaggaatatttatagctcccacagactcagatccccaagtcaccatccagaaaggtctgtttggctgcttagcagtgagcaattagaacagccagtctacccagacaccaggctggtttgtctgacctaatatacgtgaagactcagtgttcccaaagggattcttcctttttagaggaagaaattaatgatatccctttttgttaaattggtgccagtattttccctaagcagcccatttaaaagagcaaattcaaacagggtccaagaaacaattgcaagagatctacaaagatcttaggggatgagtttacacactatcctaatttcaaaggagccgtttttatgccaggacacaatggctgggttctcccaatggatacacacccactgtaaatggcaaactctgcatttgtgcagaaatcagataaatggaaagagctctagatttgtttctgctcttaactgatttgtcctccaaagcacagtttccatgctaactcattagcctgggtgaatgctgggggtaccgacgggggacagaacatccaaggatccattctaaatctccgagggtcagattacaaagtgttcattccttttttgtccttcactgctgtatttacccatgtccagagcagtcagctcacaacacacttgtactctgccttctgattttcaacttgggttgccattaagaaagcaaggtacctcccttctcttgtgtgctgcttattctttgccctagacccacattctcatattcagtccattaatggaacccccattcatgtcatgtagcagtttctatttaacactgggagggcactgggaaacagtccattatgttgtctctccccttaaaagaagagttagaatggatgcctccctctcatctaccaccctgagcaaattaacccatatgaccagaagggacaacctgtgaataaccactgaatgattagaggattgaacatatactgcataaaggttttacttactagttatctgtacccagaggattctaaacattgcccttagagtgacaatcttttcttcagcagtctgacaaatggtcatccatgctaatttcccacattcttttgcacatctttttacatcacaagcctctgtgggaggctaatggaatccatgcaccctaactctagaaaaatgcacaaatgtacaccggcaacattttgcacataaaatccttaataccttcatgttcccatcaggatctgtatcccaggttaagaattcttgtactaatgagaggaattgactaattgtaaagactatcaattttatgtttgggaagcttgatcgaaggatttttcttcccatgtggtagttcttcaagtatttgtagattgctcttttttggttagatgtctctttgggggatatgtctctataaatcatcagatgaccctcaaaagttatttaagaaaattttgtgctatgattaaagtctttgggctagaagatgtacacgcaatacataaaaagaatagacctgtggtttctcaaaaatgccaaggcaggttgctatagtctttttcttcttcattaaacaacaacaacaaaaagttgattcctttaaaaaaaaacctcagaattcttgaaaaaaataaaaacattgaatcctgtgtttattgctccatcatcttaatttgtttttgatttaaaaaattacttggccattgctcaatttttcatatttaatagaaacagaaggagaattattagtggaattctaaagttagaacatgaagattgggataatatttcacattttacttttagctctctgcaaagtggtggtaatgttttctgagccactgttacatgctcagataatttatgcacaacataaattagtgttattgctctctttgaaagcagttttttcctggttctcattcatatccgtataaacttagatgttaaccctattttgacgttttagaccactgattttaaaagagtaatgatagttccagatatctcagatattttgttttggagtttttacattgtctctagtttttctttcatcaaaggctgaaatttggtagaatttagagaagaattatgatatagaaaaataaccccaaaagccgacaaaacccaaaaataacaataacaaccaaagcttaactgaaaatctagagataatgtatttatacttggttccaggcagtcaattagccctcactaaagatgagtaagttgagtcaaatcatgcatgaatttcctaaagtcacatgattctgtaatgtgaagatattaaagatcagtaatgaggctgtgcattgacagatatttgagtcatcctttctgcctcctgtaaaatgattgcagtttgtccatttaagaaagtatttttcaaacattgattgtgatgcctgttataacagtttacatccttcctttatatagttacttcagcaatttctgtagccatgaagtggtgctttgagtctacccactaaaagtgttttcctgtctgtcatgtcacagttaactcttcacttttaaagggaaactatgtgagatgcttgctggtgtgggcctatggcctttcctcaaatccttcttataattttagcttccctacttccccatgcagataaacagaaattgactgaacactacaaagttgtaaaacatgcatacacacacacacacacacacacacacacacactctagacacacacactacacacacatacactctttctctctctctctctcacacatacacacacacacacacacacacacacatacacacacacaccccaagaatcaaacagaatctcagcaggaaacagattgcacactcaaattaggataattggagtattgtttaataaagggattattttttaaggttggggcaagatatagtgaaaccataaaggatagtgtagttctccaaggaccaatgagagtaaagccattaccacatacacgtaaaggagcaagaagagagcatggcatctggaatgcaaaaggagagagtcatatggatataggagtcatgagaagagagatgaccttcagttaaggacacagtcaacacaagacaaccccataggaagggagctggggaataaaagagaatcttctttgtccctttcttccatctgatttcctgatagggctctctattggccaaaccactgagaagccagactagtctatacaggtcagtaaaattgtgcttcagttaggaattagtctgtgctttcagaaacacatactgaaatagggtgacttcaacagacaactattttcctcatatcaccagaagtccaggggtaggcaatttctggtgttggttcagaagatcaagaatgacaagccaggccaagtctctgcaattctctccactttttcttcatagtcccaagaacatgaaagatggctactgctggagctccagccatcatggctataaaaaggattttcctagaagctctatgcaatgatctatttatatctaataggcctcctttatctacagaagaagctgggaagcatagttcagttgattacattgctgtggcatatgatttaagggttctgttatgaaggaagcagtgaagaatggatgttgagtagacaaggagtagcatctacccaagatagaatttaatcatctgaggcacatgtgcccagggcattgtttcatgctcatttctgaacttgagaattttcaaatcatgtgaatgatcagatttcaccttgggtccttcttcatgagatatcaagacctgcaggcaagagaaggaccacttagatgaaatggctataaaattctaaggcagccaggtgtggtggctcacgtctgtaatcccagcactttgggaggccaaggttggtggatcacttaaggtctggagttcaagaccagcctggccaacatggtgaaaccccatctctactaaaaatacaaaaattagccaggtgtgatggtacatgcctgtaatcccagctacttgagaggctgaggcaggagaagcacttgaacccaggagatggaggtggcagtgggctgagatcgcaccactgcactccagcctgggcaatggaacgagcctccatctcaaaaagtaaataaataaattcattctaaggcaaatatttaagtgtgtcttgtggaaacagtttgtgcaaataaaatgaagttatttctggtattccagaaataagagaaatggaaaagacacactttgttagcatgctgatcgaagtataaagatacaatttttatacaaaaatatttgcaatatgtattgagagcattgaaaaaatgtttggatgctttattccaacaattcgctcagaatcttttttttttaagttcagaaaaagttaagagaacaagtaaataaattctacagccacactgtagaataatatgtaactgttaaaaattacatttacaaagtatttaatgtgtggaagacttttttattatcataataacctaaggttctgctgcagttttgcctggagtattctctaattccataaggtctctcttttaatatccaattaaaattgcttgattttccatcccactaaatagtaaaatttatattctctattcttttgctgcctgtcacaactcaaactgcagggggaaaaactcctttagaaagaaattgacaaagaattttaaagggcagttcataaaaggagaaagtgcaagtgaccatgactccatgcaaaaatgttcaacctcgaaatttaatgagaaataaattttttttgcatatcaaacaggcgaggattgaacaaaaaagatagtacatgggctgtcaagaatacaaggaaatgagcattcgtagtattgtttggggcaggaaacagcctttttgtagagcaatctgccaatatattatttgacccagcaatacctgttttataaacttatcctttgtacgtaattggattaagctatgcataatatttttgtgaagtttgtactgaaacaaaaactgaatgatgttcattttgggtcatcatgagaatggtggtagatgaacagaggaacaggaaactgctcaacgtggtacctagcacacagtaagtgcctaataagtgtttgccgaatgatgaattcattcagatgggtagtctctaagggagaaattggttttgtttcaaatggcatcttgcatcttgcattttagtcacactttgtagatatttcttgtcaacagttgtagccataggactggagctcaggagatgggcacagctgtctgtctagaacagtgggggactataaggaatgacatttctgtttgtctttttttatatagtcaaattcattgtgaaaatgaagtctccaagtgagagtagagaaagagattagtagtgggccttaaaaagtctgcagggggcaaggtagaccaagtgaggttactcttgtgatttatgtaactgcatacaatactttcgatgagagaaaaattaactgggttatctgattgataagcataatcattttagataaatttgcatagtctatggagatggtctcaggccctactgagagaggagggtgtagcttgctttaaagtcttttctcctcctatgctcaaatgcttttcccataacacacctcaaaaatccccaaacctttgttgcaagagtctggactataataatcagtgaaggcaacttgaaatattagtcttcatatcagtaggttatagtacattaaaatatacttggattttaaagatgaaaacatgctgaattagaaacttctgcaagtttcattattttctcagtaattcccaacagattgtactcaaatcatttaatgtaagaaagcatctaaaataggagattaaggaatttattcttaactgtttatgttacaaaaggatgaagtaatgctgctagttagaatgattatttcgggttgaaagtgcagtgtaagtacatggtgacaaataaaaattatgagttctaaaatatggcattgcataatcattttgttgattgtaatgcttgagtgtttttaccatgtgaaccatgtaggcaataatgttaaaatagtttaaagtttagtctctttttgaatatgcattacagctagaattctgtcacctggatttttctgggttctgcttacccaggtaactaaatattactgatcttatagagggagttatgagtagccagtgagaaaattctaatttcttcaataacatttttcactgatcactttattactgatatccccactaagtttattaaaatattgaaatctctggagttactagatcacacaggtagaagaaagctcaaattttaaaaagttgtgtaccaagtgtgaatggatttaggattttgaagagggtctcattctcagtaaataaatcttctctatataaatctggagttcaaacggttctgattagagccctgctgtcttactggtacctcctggaaagcaattagattagtagagtgcatgaatcctttatatcttgtcatgattgagtccaggtttgaaagcagggcagtaaccctgatgaagaaccacatcattctgtgcctgagtcacagactcagactttaacatggctgtttttcaaccatccaatctttaatattgtcgtattttaaactgagacacttagccaagtggcatatgaaaaagaggtggtagaatctttgcaggcaaccttctgtggaaacaacaatttgagctgtatttattgcataaattgttatgaagaggatgtcttcttgtctttccagagcctatttcctaagagcaaaaattaaataaggcagtagaggaagaagaggagctgatttagttctaaacttaaaataccaattttaataatgtattctactgaaattgtcattctgataccaaaatcatggctagatgagtattaatgaaatgaataaggatttcaataagatttttgtgaatttctttaagattctcagctaaccatgtaaattttttcccgtaaccactgattttagttgatgctagtgaagggtaggggacatccaaagcaaaggactaatagaaatgtttaaagccctctttggacctaaaagtatgacattcctttgtttttattgtttttaatcacataatgaaatgtttatgaaagttaacaggacacaaaactccaatcagagcagcaaagaacaaatcattgcgctttgcttctgtcagcagaaaatgctttgtttcagtctttggctgaagttggaaggggaatgaccttctgaacagctcttatggtaatgctgagaggcctccaggcagaaagtccagtgcaaaaagtacaacacagcaagagtgacaaactgagtatcactgtgagaaaagccgacatgactccaggtgtttggagagtagcatcttaagtagtcttgacacagacccaaattctgaaaagtttgatgaaatttagacatgggatggtgaaaagccatgcacatttttatgtgcttttaagtaaacctttatattccatctaacaactttttaaagaagtagtaatataacatcacatagaaaatgaatacattttataatggaacttcaagcaaggtgccaaggtgcactgatgggtcatggatgtgttatggttgtgccaagatattgataccctcagctttcaaagcagccaggcagtactgggcaactggaggcacctctgtctacttgatctctgtttaccagaccagaccgtacaaatattattattttctatgtgtgccatgacatggcaaagcctgaaaaactctgctttgcagatatactttgcaaaacccctgaattccaataagaaggggtatgtaaagttatcttatgtctaaataaacagaggcagaaagagtgtggtatatattcccagatactatgcacaatgcatttggtaataacaggggcagagtatggaagaaggccagtgatggaaggccagggacttcccgtctgggcttttctgcttcttctgcctgactgcactgactctctaacaataaatattcagaaattttctagcaaatgttcaggagtgaaggcatatggagcgtttgattttgtttgtgtttaaaatattgtttccacacagatggcattggtttagctattgtgtgactttgtttggatcttcttttgcccaaataagagatgagaaccatagctctttgaaactcaagctaccaggtttgtattctgcagtttgccccaccacattctgcagaggctcttgtcccattttgtccacaaagatacctttgcatatcaatgagaatacagtgactttcagcaatgatttcaattggctcttgaaatataaggattaagacataaaaggagaccgtgaaaattgcgtgaactgtgggtttagatgtttagatatttagattccagagtgcagtgactgtagcagcaatctggccctgatactagggctgacaaagtcaactcactgtttctttaaaaagtaaagaagactgttggacagtcttcttaaaagatgtttagggaaaaggtctacaaaaaatgaacttggtgacatgtgtgtcctattagataagtttctgttttgtatctaaagatatttttagacatccagtctgccatgttgttgcttctaaccttgttagtgccggtgggtagggggagagaaaaacaagcaaacacatagaaataataccttaaaatacaataaatttataaaattgcgaacgtttttcttttattaaccatcatgactacgctttcctattaccaaggacctcaatactactccagggaacaagagagtgcctactttgtttcctcccctctgtatttagctttctttcacccattcttccaaaagttgactaaagtcagagtctcacttttgcatctccccagagctaggcaaaaaaaagtctacttccagcaatactcaaatatatgttcttcccttcacaataatgactgtataataagatacccacttagtcagtaacagcctctaaaagctgttcttctggaatctgtggacctgaacttgaattgtatgctaattcataagcagaagagccatttccttcctggaatcttgtgagagggagagacagaatctataaaactgggctgagttttttttttttttttttaagctttactttttgaattgtgatccataggaaaccgagagttggctgggtgaggtggctcacacctgtaatcccaacactctggatggccaagatgggcagatcacttgaggtcaggagttcaagaccagcctggccaacatggtgaaaccccatttctactaaaaataaaaaaattagccagccatggtggcacatgcctgtaatcccagctactcaggaggctgagacaggagaatcacttgaaccctggggcggaggtttcagtgagctgagattgcaccacagcactccagcctgggcgacagagcaaggctctatctcgaaaaaaaaaaaaaaaaaaagtaagaaaactgagagtcatggaaacgttttgctcttctattccctaaatcctagaattcagactgttttgccaggtctttctgaaggacctggctcttttaaaaagctcctcaagataagacaacatggattatttgaacatgagcatatttcacctacctaaacccaatttaactagaagagggttaaggagactcagacactggtgtgattctggaggaagatccaagattaatatactgagatgccagaactattgtttcaaatgttgcaaaatcagatttagatcttgtatgaaagttcttggctgaagaaaaagagttttccaacttagagagaaaaccaactttgcccatctgctgtaacaagactaagtaaggaaatgatgtttagagggaaaggagacttgaatgtaaaacattagtttgaagattggagttgagttggtttgtctatcttcctttttatttagctgcttcttttacgctaggaaaccttatattatgagatacataattaatcttttttatattagatctctgtgaaccaaataaaagaatatttccatctcaccggtgaggaaactgctgcttataaaggttgggtgcattggccacattcattgagccagaaagtttggagccaagatgcaacccaggctcttttcactccagcgcctgggctctagcagaccttgctatgccttccacagcaaattactctactcagtgttgtaagacacgtaactgtgctttttggcggttttccttgatcattattgtaaggccagcggggctgattttatttagcaaatgaccattttgattatttgtccttgaagaaacagtcatttgcgcgttattctggccttgtttttggattctttatttgatttttttttagtggtttttcaaatttccaggcagttctcaattgttgcacaaatatcaaaatgctctacaaactagcattatcccagcaaccctctttgagcctcttgctctcattgctctctgtgtggtgctaggaatgtagatggaactcaatctctgtgaaacgaatgaggctatcccatcatcctaaaaggatcaccaataacatctcttttgctgaagtaggattacctccaaaaaacatatttttaatataaccttatgtttcttaagacaggtaacatgtatatagatttaatttttcaggctagctggctttcaccaagcaatgagtaatttccaaaggaataggagatgttagtggaggtttttgagcaagagcaactaaaggatttattcattcctgaatatacattcctttgttatttggtatgatccatgccacagaaatagaaatatgaatgattctgtacctgccctcaggtgggtaatattattatgttgttatgtacacgatgaaatgggagccctgtggaagcgcatttaacatggacctagaagtcagggaaggcttccaggagaagatgagactgaggtgtttcttatggggctagcaaagctagtagtttgttttgttagagtgtaggctgagttctgaggaatggcaggagatgagctggagagaggtaagtaggtgtcagattaggaagggctttgtgtgctgaagagtgccatttttgttctgaatgttgtggagaaccactaaagatagtaagcagaggcatgacatgttcatttagaagattatactgtctaccatgtagagaatagataggatagtacaaaactagagatgagattagcagagaggctgtcactgtggtccaagcaagaactgatgagagcccgagtcaaagcagtgagatagatgggatgattcatgtagggaggataaaagtggagtatatagggcttgatgactgatatatggtggggagtaatagagggaggaatctggaatgatgaggaatctggaatgtttctgacttgtgttctctctgaacacactgcagaaaagtgatgccttttcaacaactttttaaggcagtaaatctcaatgacagctgctaacatgatgatgaaatgatgctagagaaataagcctgtaaacaagggtcagtctttcagtataccattgaaacatcagtggtcagatgatagagaggtggaggaagcattcaaaggttaacacctcaaccaggagcagtggctcacctcctgtaatcccagcactttgggaggctgaggcaggtagattgcttgagctcaggagttcaagaccagcttgggcaacatgacaaaaccctttctctggtcgggcatggtggctcacgcctgtaatcccagcaatttaggaggccgaggcgggtggatcacgaggtcaggggttcgagaccagcctgaccaacatggtgaaaccccgtctctactaaaaatacaaaaattagctgggtgtggtggcgggtgcctataatcccagctactcaggaggctgaggcaggagaattgcttgaacctgggaggcggaggttgcagtgagctgagattgcgccactgcatgccagcctgggtgacagagcaagactctgtctcaaaaaaaaaaaaacccatctctacaaaaaatacaaaaattagctgagtgtggtggtgtgctcctgaagtcccagctacttgtggaactgagatgggaggattacttgagaacaggagcttgaggctgcagtgagccatgattgcaccactgcactccagcctgggcaatgaccctatatcaaaaaaaaaaaaaaaaaggtaaggacctcctcctcctcccaccaacagcatatgccctatgctcaaggccaaagttagcaccttttgatgtgatgcaccccttgtacaacatggcagatattccactggataatcctctttttgaaataattttaacaaacataaatatctacaaatatgttttgcttagtttaagaatcaaatgcacaatgtaatattatgtcgtgaatctccacctggtttctcacttattccagaccaaaatattatgagaaataattaatgactgttttttccctagttattccttagtctcttatcccttcagtaattcattgtataaactctaatctcccatgcttagtattttggctttgccttttagttggtctttgtgttttagtgatcagagctaggactctgataaaaggtatatattctttagaggtacagtataaatctgtaaggcagaaccactctgtcttctagagagagtctctagaagaattctgttattctagaaattggactgcttctaggggatactatatatatatatacacctagtatacatatatatgtagtaaacatatgtaataaacatatatgtatactgtgtgtatatatatatatatatatatatgtatgctatgttgtactagcaaagtttaactgaatttagaatcaaactgaattatctaataactagtaggatgtagcatgcttgtgaatcaaagtacaagaagactatagagtggatacctgtgtgattaattaaaaattaattcttccaaaaacagctgcatataggcctaagaacataactctcctatggttcaaaggggctgtcaattccattataagtctaggttactgtttattttccaaagtaaaatgaacagctggcaaaaggcaattaaccttataaataatcagaaataatttgtgctatttagtggcatacaaatgccactttagttggcctttcattgctataaaattctcctaaaaatattttgtaccattattaaataagctctaaggggagggaatgactttctcagcacaaactggaagaatatttcaaggtaagaagtgaaaagataatgctaatatatatttgatttttttaagaaaaaagagacttgttaaaagactagatgtgatcataaataggacatataagtgatcctgcttaagacgaatttctatcaatcaaccatagttgcctttttccctccctagtcattctcaagttaattattaactagaatctcagttaagtttgaagttcctttaaattgtgttcagtgactgccttgttattatttcttactagtgcttagagttggaatatgccttagaattcaccattagaaaacaccctcttttataatacaggaaactgagggccaagaaagcaaaatgacttgcagcagctcaaaggaaacaaagaaggctcccaccccacactgcttcagaaccctgaagcacttaatagaatgtgcatatattcattaatcagaaacactttattgtgttcatttactaaagataagtaaatcacaaagcctttactagtttagccctgaaatgtgaccatcttgatgatatgcatgcacggtaggttctcattaacctttgtcagatttaagtatacttaattctaattggctttattttcagttggccgttatttgatttattgagatcgactaatgtaatatatggtttttaggatttcaacacaatttggggatttttttgcaatgcagatattttccttttgcccaaggtaataatagacagggatgaaaacactactttaaagagggtgtctgctgatttacatattttaaaagtattaagatcaaaggtaatgagaatttaatccatatggcatgcagaagataaataagaatattaatactgtatcaaatactaattaaaagaaacacatggatctaattttaagaatgtaacgcaaggatgaaatactctttgtaaagttaaaacacgattctcttgtaaaaaggacagttatggtgagttgtttttcccctctcagggtgaaaactggctggttcatatatacagctttcttagaatcagggtaataattatgagcacagtgattgtgccttaacagttaacaaagtgctttcacatcttttttgatcctcaaagaaaatcttttagttcctagaactcttacccctgtttcactgaagaggaaatatgctcatagaggcaaatgaacttggacctaataaatcagtctcagtcttgatctccttctccctctccctcttctctttcccctttcacttaccctccccactccctttaataataattagaagagtgcagggagatgagcactctcattcactgggaataagcgtgtgtaaactggttttgagagtacctataacttataatcagagatgtagtgaaatatttatgcctagggatgtttgtgacacttctaattgaaaaattttaataaaccaagtgtccaacaaaagaatatttgggttttattgtatcttaaatgatataatcttagggcactattaaaatcatgtttacaaagaatccttacagtttaccagcaagtgtttgtatttaaatgttaggaaagaagtcgaaaataaagtatataatataaatttcatatatgtatttatatattcccatatgtttatatttttttcctctctatcaggggtcagcaaatatttcatgaaagaaaccagagagtcaatagttcaggctttttgggtcttaaggtctctgttgcagttattcagctctgccattgtagggtaaaaaaagcatagacagtagataaataaacatgaatgtggttccagtaaaactttatttctgtgcactgagatttgaacttcatataatttttatgtcccacaaaatattattagtgttttgggctttttttctaaccatttaaaaatgtacaaaccatccttagctcatgggctgtccctaaacagatatgggccaatggtcatatcaacccaattgatattatggacaaacataccctaaaatagtcagttacctctgggtaacaagattataggcagtccttactttcttccttaatacttacctatacttctaatatttcctctaatacatattctatactttaaaaatacaaggaaaaagcattttttaaaagaaaaagtgtgtccaagcttaacaaatcgtaactggcagggacaggttttgaacagaaaacccctttctcccattcgtattgcctcctagactctcgtagctgaaaggattctttagagatttatgaacagtctattcccttattttacaaaagaaataaagactccaaaaacttaaacagcttacccaagatcatgaggcaattagtggcagagtcccagctagccaaagtccccagactccctatgcagtgctctttctttaaagaatttaacaattcaacattttttctagttgttaacctatattagagaactgaaaaagacagaaaggggatgcagcagtatcccagagaataattttaggaagcagctaccactcctaaaggctgaggaacagagagaagatgtgattgttggaacttagacttggatgaggggcctcatatagttgaaactcagacctctgtgtagggttactgtccggctgatgctggtctctgaagggattgctgaggctagttctgggagtatggggaccctgcaaactggaactactgctacagctgaaatcaagcattgctgccagaatgaagatctgttgctgtggtgaccgtggtaggaacaagaagcaaaccggaagaagcaagtccctcttctccctcgtgccttgtagttttcctctagcatcccctgttgggagtccagtggagagtcatatggcaaagaagtatgatttgtggagtcccattccaccgtcacacagagcatgaggctatgagtgatattattaggacgagaaagaaagagaaaagaaattaatgttcttgtgtgtacatacttgcgcattaaaacaagcaagaagaaaatgtatataactgctatagtccttgttactataagtgaaatggtcacaaagcaatagttgatgcttataattttcttattccttactctatgatctcttagcagggacctcagcttgttgagattctttgcctggcaaggtgagcctagcctcattcctgaagggtctgaatcaccagcggttctgcagatttctgcttgctgtagttttctgtaaacctttactattagacatgcaagtactaagaagtactcagagaatatcctgggctccagacatagtcctctttgcccccattgtatagccccaatcctagctaatcaggatcaatacatccaacagagtaatttctttgcctattggttcagttgcataaggaagccaaatgccaagtggcagtgtcagcctctaattcagtggaaccattgttgcatcccttggtagaagcattcccttcttaagtaccaagatcttcgaaccagtagaactcaaagttgtgaggagaaagagcaaaaaattctatgtaaagctattttaattattttaaaagtaattttaaaaatccagagtggatcgattagctctgatttatcatttccctgaaaatatatttttacctttgacattaatctccttgaggacaaaatctgtagctggttcatgttcacatatccagtgggccttattatacatctgttacctggcaggcactcaataaaccctggttgaatgtgtaggttgacaggtagctataaaccagcttatattgactaactggttaaaattagaagactaacaattttaaattttcctttgctaccttgcacgtgaaatctgtttcttccatctctggacttacgaataaactctagtaatttgtgactcagcaattccgttgatcagtattaggctgttgattacaagaatatgaattcctcaggggagacagtgggtctccactccccatcagagaattgtagctttgggtagtgttaatattactgggcactttaaaatgaaatatcttaaattttagaagattcattttcctgtgagtgacttgaagcagagaagcatttcattagctcctcttcccaagtcctgaggaacttctgaaatgtgaaccaaagcagtcttccactgcccggagctccttcacaacatcaaacacttaataaaaatgttttccttaaacctcaagcatttccaaatattaaatgtgaaggggaaagattttgctcaaactgcaaagtgttctagaactggagggtatgtgagaatatgtgtgtactgtatgtgtgtgtgcacgtttacatgcacacacaggtatgtttttcctgtttaatattttggaaattgatttaatattaggcccaaaccctctctaaacaaggttgcataaacaaacatacctgcttatgtttggctggtccccaatgttaacgtcaagggttcattaggaggaggtagaaggggcatatgctctccccacaacccagacaagctgttagcctgagaacaagtgggttctcacagacaaggtcgcagcctgcggctcttggggtcgtgatgtctggagacctgagggacattgtttgtggggaggaggaaggcggggccaaaagggtgaccactcagattaatttggattgtatctatcttactgaagcacaatttaagggatggcctggacttttaaaacagaacagctgttttgcatttgaagtttcactctctactgagtttctatgaagtactttgttttaaacaaaccatatcaaaagtagttcccagtgagtgggtgttggaaacttagtgtacattttctgttgaagtatttcgaaagcatcgaaggtaaacaggtgaaggctgttaattacgactaattttaattactactaaaatttacattttacataatctgtgcgttgttaaaaatgtattcaacgtcctagtgtgttaatgtattcactgcattatccacagtttgtactcatttctctaaactaactgctaaaaaaatatttccgatgttcactgtgaaacttgctttaacaagtagatattgtggtctaagtgaacggacgtccgctgccccgctgcgaggaattgtgctgtcctcagcctgttgtggcattacgcagagggccttgaaacctacccaaggcttggctctttagcagtagctccaaagcgcttagcattttcttagaagaatgacttggtactgaaattttgtatagtctggggagcagcaagttattgtactcaggaagttcacattctgattagtctgtaaatcctgggtaaactcaaagtgatggattgaatataattactcagtatgtttgcagtgcacatcgccatagaaacaactattcatataaagcaatagaagtataattcttggttgtgtaactagttatgtggaaaaactatgactagcaaagaactgcagaatcaggatcatcaaatgtaaagatttgcattctgtaaacaatatgctttgtttgcatgagaccatttcaagcaatttgagcacagtggggcactactagttacaacccaatactcagtcctttgatttttaaaaatataattatgaagtatattataaacgaaatataattagtatattataaataaaatataattatatttcaaacatccagaagagagggaaaataccaaaaaccacccacataataggttttaacattttaccgtatttgcttcaagtcttgttaaattgaaattctgttgcaacccccaccattcctctgtcccagttctatccttcttctcttatctccatagtaattgctatcctgaattttcattttattccctaccatatttttatatttttactaaatgtgtaggcagaagccaatttttcctgaagcaaaggaatactgggcctctgggccagtcactcctaccacttcctccaaggcccagaagttgtcagggccattgtcagggaagcagccacagccacaggctagaaacctggagcaccaccacagcctgggaggcagtgccaggtcttcagtgggtggtcttggagccattggcactacctccagagcctcccagctcccaaggaaaacctgctcttgatggatcccccagtgcctctgatgaccatacgttaccctgtgtgaactgatgaccgtacattatcctgtgtgaaggttctgctccttgttcaggggccacagcccaggctgctctgggaaccctgcccagagaggtcaaacagctactctgctatctaagaacagaaattacagagttgtgatgcttaaagactcttttctaaagtgctatttttcttccttaaatttgttgatcaaccgtgctagagaaaaaaatggcattatcttttcactctttacagaaaaatttattaccatattagagttaaaaagaatgcagctaatgaatataagaaaaacaatattatcaaggtatgtctaatagtaatcataaaggcatgtctaatagttaataatatcacattgtttttctggactttattatttagggtatttgccagcttttgcaattttataacagtatgattttttcttattcaaacttgatattcaattttgtacctaattttatatttataattttatattccttttcttaaaagcaagtgctcaggccaggcacagtggctcatgcctgtaatcccaacgctttaggaggtcgaagtgggcagattgcccaaggtcaggagttcaagaccagcctggccaacatggcaaaaccccgtctctactaaaaatacaaaaatcagctgggtgtggtggcacatgcctgtaatcccagctacttgggaggctgaggcaggagaatcgcttgaacctgggaggcggaggttgcagtgagctgagatcgcaccactgcactccagccagggtgacagagcgagatccgtctcaaaaacaaaaacaaaagaaaacaaaatataaaaaaccactcctcaaattgtataagcttcaggtcccacaaaaccttatatatgtgtgtgtgtgtgtgtgtgtgtgtgtgtgtgtgtgtgtgtatgaaagcgtaaatagtatatgtttttaatctttgtataaatgcagaatatatttatcactctgcagggttttatttttccttgaaatgtttccaatatttatcacgttgatacatatagaactctcattaatttcatgactacaacacaatattctcttttttattgtcattttggttgttcatgatttctcgctattataaatgacgctgtgatggatgttcttgtatatatctcttcatgtagaagcacaagaaaatttctggggtatatatctccctaggaaggaattgctaagccacacaggatgcacatctaccattcagaatattgccaacttgctctccaaacatgtagtacaaatttgcactcataccagcagactgatgaaccttccttttctccatattctcaccaactctttgaatttccagattaaaaaaataaatttcggagtcagaaacacaaatgacatatcgctttttttgcttgtctctgattaataataaagatagtcactttctcatgtgttactttttggtgaactacgtattcatgtcctttgtccatttttcatttttttgtaagaattatttctatattgtggctattaattatttgcagattatatgcattgcaaatatattctcctagcctgtgccttgccttctgtatgtatatgtagcattctttattgaacagatgattttaattttaacagttttattagtttcttttttaatggcttatgtgccttaagaagtctttcctccacaaacttataaagatattaagccttatatctttttaaagttttaatctttttttttcacacataggtaatcactccacctcaaatttatttttatatatgatatatgggatgaacttaattttctttttttctatatggataactaataggtccagctccatttattgaatagtgcatcctttccctattagatcttgctcaaccctcacaattttagctaaacaacctaacctctgatttattataaaagctaatatttactgtatatacaataataacatcacacttttgatgatgatggcatatgttaataagctatcttctcaggcaagattttttcatggcaagtttaccaaagctataaaaaatgtgcaatggaaaggagacaaaagatgtgtgtcattattaacaggtaaaaacacccccaaaagttgaggatcaccttaatgtaatgtgggatatacaccaagattggacaggccaacagttgtaaggcagttgtaaggcagcctattgatttataaattaccttctatccacttttggggaagaaaaaaataaatatctgcaagggcaaagattctttcatgcaacataacttcgtgaagaagtagttttaggaccgtaatcagattaaagttcatgatggctacagacgcactaccagcaggtctgtagaattcccaggaagcaaagggataggagcttctggggtttgatgtcattcagagaagcaaatgaagttagtgtaacaagtgttgcttccctacttctactctggaaagaaaacaggacaataaaggcttcgtggcaaatgtgcgtggggtggagtcaagctttagggaagcagcactgtttgcagggaagatgacctcactgccctcctcttcagttctggtatcatttttgggtgagctgaatccaaccatacatccctggtgaggggtgctctaaatggctgccaagatggcccctccagtgggcagcactgattgacaggtgctcagcaaggccttgttctccaaagcaggaagaaatcccgtttccttcagtggcttgctttttcttccaccttcctttctgccactttgccaccctagccttcctctacttctttcttcctctctcaactttttattaaaaaaagaaagaaaaatcccagcaggagttgttgctcctagttcccctggaaaagcgaaataagtactcagcaacaggcattaaatattcaggccttttgttaagaaaaaaatcgtcattgtggtttttctttcttgaggcccaggggagagaaacaatgggattttctctctccctcttccacagaattccctcctgagcttattctctggaggtcaacagatccttttcagccacagctcacttcaaaggatataaaagcagtagcttggctaggagacacaacccctttgccacaaaaactagccttggactctctggctgctcctgacagctccccctgccctggagtgctgccacactgcagagtctacccgccccaccgcctgacaccccgcacaccccccactgcagcccctccaccccctcccccttgactgagctctgatgattatttgagtgtatttatgtgtgtaactaccccttgtctcccttaccagactgatagattttttagagcagggataaagtctagctcaatataatccacatctgatccctacctagggttgatcacagagaaagtgctcagggagagatctcagcctgcctcacctgctgacatgaggcagaggctctcagtggttcagtcctttctcgctgagccttgcctgcaggcctcgaagaacatggcatcatttctaaatttgcctccaccgttcccttggccacatcaaaatctctagaagaaatgggagtgacaggtcaaggctacgagcttggttttttttgaatttttattttacttagggccactggtctgtattcatatataaacccaagtctttgctcttagggctccacttctataataattgcatttctctgtggaaaaattaagatggatactaggattgtctatgcatagtaaataacaacagcaaatatttcttgagcactttattctgtgcatggaactgggttaagtgtttttcacacaatattgtatttaatcctgacaatatctttttaagtaggctagtatctaaaatatctagtatctaaaaggtactcttccttgatgagcaaacagtttgagagaagtttagctccttgcccaaggtcacacagctggcaaatagtacattgtgacttcagactcagtctcacggtaaggaaaaaatcttttccatcttgaagatgtgattttccatatgtaacagtaaacttaaaaaaaattaaacctcagaaagcaagctaacttacaaaagaccttttttgttttcaagataacctggcaaagagctgtatatttctcctctcctgtccctgtcttgttctctttccttctgtctatagttacatttacacaatgccaaactagtggatcaaaacaaaaatatagtgacacccagatgtagagaatgtcttatgtgcatgccaccaggcttttggccaattaaatgaatctgaattttttatttgattttaaacttttcatccaggattgtggtccccctatggggctctaattctgtggtgtatctccctccaacaaacttggaaaaagttatgaaattgaagagggtgaggtgtgggtatttatatcaaagctatggataaagttttttaattttttttttctttttaagagtaaaacagggtctgtacacccatcaccatttttataaagtatttatttaccaattagtccacactatcaactggttgatttaatgatctctcacatgagttatgcataacttttattacttgagcctgtggagatgaagggcagatataaattaatgtggaaaatgtattgcttgtcattcctttaagaaaatacagttctcttcaactatctttgctgttcatgttttttcccccattaagtgtttcttggattttaggtaaagaattgcataagtgccagagaatactcatagggattaggtgttggattggacctttcgcacttgttaacgtgattaataagaccttttattgatctgtaacttgattcttaatagctacattatttcaaagggagaaggcaataagcttaagttaaaaggcaacttagaatttccaacattgccatcagccacacaagctgctaatgagttatttttaggctgtctgcctttgattctaacccataggagaaaaattgaaataaattttcagtagacagtaggtagttactctagaaatctgggatgcttttaagaggtcagctgaactgagaacctttccacctttgtgttatcagctcgtgaaatgcaggttcatgctattgactgttattcctctcatgcagcagttctcaaccttggctacacattgaaatcaccagaggagctttaaagaatattgatctgctggagtcccacctccagagattctgatgtaattgttctggggtgtggcctggccattgggattattttaaagttctccagatgactctaatgtgcagccaaggttgaaaattactgctctaggggcatgcacaaaaaggaaagctgataaataagtcttacacataaattccagcatgtcctcaggtttctactagcctaaataatgcatcccaggtgagtaatgtagtactcatagtaattctttgtgtcctgagccaagaagagtttcaggagtcacttgagcatgtcttcattttatgcagttggggaggacccaaaaaaagtatcagttcttatacccaactcccctctgaaagcttcagacagaaaaaaaaagcaacatggatgtgctacctgctcacctccacctcccgcctgcattgtagagccttgagctcttgcagaaccatcctcaattttttacacctttttgtagtttttcaggagtggacacactaggcacaggtactttcttggcctggcccccttgtgagatctgtgagatgatcagctagcattaggggtaccgtttgtgggcagtacaacagtccaagtgatcaggacacctatagctctggccttaccagcaacaggctctgaacaagcaataagtaaggaaatcgagtcacagttcttggagttggaaaccacttcaagaaatcacacagtggccaggcgtggtggctcacgcctgtaatcccagcactttaggaggctgaggcgggtggatcacttgaggccaggagttcgagactgacctggctaacatggcgaaaccctgtctctactaaaaatattaagataaaagtttgccgggcatggtggcgcgtgcctgtagtcccagctacttgggaggctgaggcaggccagggggaggttgcattccagcctgggccacagaggagactttgtctcaaaacaaaacaaaaaacaaacaaacaaacaaaaatcacacaagtgtttgttcagggaaagaaggttttattgtcctcagttaggaagcagcacctttggcggagtgaatttactaagcagtggagtgaaaactggaaactagaatgcagatctttttctagtaaacactatattataatccaaaagtatatctctagattcctttgtgtttggtctttgactttgtgggatgtagccatttgttttggttgccttagccctgtgacctaaagttcacaggtccaatcattttgcagttcctctgcactagactcaacagaaacataaggctcagagcagtaattttcacagcagcctggacctcaccaacgtgatttatgtgtttttacttggagaatatactttaatgctgagatttttctgattatctttttgtgtgcacccgctcaccacatgggctcttaatttagaaaatatttagcaattacatgtggagttgatactttacataaaagcaaaaatggtgcctgttatgtatgttactaaaaattttgatgtcttttatttttctggcaacagagatacatgacccaaagaaatggctcattatttttcattttctgtgagatgaaaagttcttaatttaaaagtggatctgcccctggaataaaggtcacatggtagaagttttcgttttagtggtcctgaagcctttgccaggcaccagagatactgctgtgtactcataaattttaattactgatggctgggagccaaatctaagtttgatttgaactaattctaaaattttgtgaaattaattttgatgtcaaaatcagatatcttggcagccttttagaacataattcttccagaacttctactttgacaattgattatccaaatatttaagagtttgtataaacaacactcaactaaaagctttggaactcaattcgtatggattttctccttttaatgaatgaatatgttggttttctctcttgccaagtctacccaatgccaacaaagcaagaatttcagcatttttgctgaagggtcactttgtgataagagaaaaattacataaacatctgtgctaccagttgtgtaaaagtgtagcacatacacatgtatattacataattttagataatgataatactgacttatgtatttactatactgtactttttattattatgccttctacttataaaacaatgtgtgctgtaagacagtatgccatgttatgccagcagcagcctcatacatcttgtgtttaccacatctcttgattgcatcattttctcttgtgcttgatttaatctcatgttgttttgttcattatggcccctaagtgtacaaaacttatggctaatgttgccagtaagaggccacattgagtgactgacctcgaaataaaagtgattaagaaccacttaattacaaaggtagaaagtcagtgatggttattgctcaccagtcaggtacgtcctattccaccatagctatgatcttgaagaacaagagcaaagtgatggaagttgttaagggatcggctttattgaaaataatgagactcacaaaaatgcaagaagggtctgtatcacatatagagaaacttttaatgacctggactgatggccaatcacagaagcacattcttctcagtaccataatgatcacagcccaggcagaaggtttgtttgcagtgtaaaagaaaggccagacctgactacagtgttgaatttactgttagctgtagatgatttaaacaattcaagacttgttattcactacataatgcaaaagtgagcactgaatctgtgagtgctgatatgaaagcagctgaagaatttttggaaactctagataagctgattatggaggaaaattacttgtcagagcaaattttcagtatggatgaaacctccctattctagaaatagatctctacatggacttatacatatggaggccatatggacaagtcaatgtcaggtttcaaggcttttaagaagaggataacagtcttggttggggggagtgttgaaggctacaaattaaaaccctttgtgatctggcactatgagaaccccagggacttcaagtatatcaataaacacacacaagacaggcttggtgactcacttctgtaatcctagccctttgggaggccgaggagggtggatcccttcaggctaagaacttcaagacagcctgggcaacatagtgagacttcatctctatacaaaaaaaagaaaaaaaaaattagccgggtgtagtggcacatacctgtagtcctagctactcaggaggctgaggcaggaggatttcttaagcccaggattttgaggttgtagtaagcaaggatcttgccattgcactccagcctgggtgatagagcaagaccctggctcaaaaaaagggagagggcacacagtgccagtgtactacaggagcaataagaagtcagggttgactcaactcctcttccaggatgccctcctgaattgctatgccagtgaaatgaagtaccgtttggagaataccttccaagattttgcatattgttgatgatgctcccacacagtcttcttttattgacgatctttatcccaacatcaaagtggcatttctccttccaaatatcacccctgacccaaccaatggatcaaggagttatagcagcttttaaggtctactgcctgaagaggacctttgttcaagctattgctgcagctgaggaagacactgagaaaacactgatgcaattctggaaggattataacatctatgactgcatcaggaaccttgcttgggcatggggtaatgtcaccaaagaatctatgaatgtcatctggaagatgacactcaagaggttcatccatgattttaaagaatttgccaacgttgcaaaaatcaacaaggctgtggttgagacggccaacaactttaacctgggtgtgaataagaatgagattgggagcttccagaagtgattcctgaggaattaactaatagttagttactggaactggaacaagaacatgtagctgaagaagaggcaagagaaaaggaaactacaggagaagatgaaaaaaagaagaatccccaagaaaattcagggtttagcagaagttttgcagacctcaagaagctccttaaaaagtttgatatcatggaccccaacactgaaaggttttcgataatacagaggatgttcgtggtgtattatctgcttacaagaaaacctataatgaaaaaaagaaacgaaccaagtaaactactatggacattatttctgaaaagagtgacaccacctcctcaagaagagcctcaggcaggtcctttaggaggtgtttcagaaggcattgttgtcataggagatgacagatccgtgcatattcttgcctctgaagaccttccagtgggacaagatatggaggtagaagacagtgatatagatgatcctgatcttgtgtaggcctaggttaatgtatatgtttttgtcttagtttttaacaaaaaaaagttttaaaagtaaaaaaaattttaaatagaaaaaagcttatagaataaagatataaagaaaatgtttttgtacagctgcacaatgtgtttatgttttgagctaagtgttattatgagtcaaaacatttagaaaatttaagtttataaggttaaaaagttacagtaagctaaggttaatttattattgaagaaagaaacaattttaaataaatttagtgtagtctaagtgtatagtgtttataaactctggcaatgtatagtaatgtccttcgcattcactcactgacgcacccagtgcaacttccaatcctgtaagcatcatttatgtcaagtgccctatacagaggtaccattttttatctttcatatctatttttactgtgccttttctatgtttagatacacaaataccatcgtattgtaattgcctattgtaatatgatgtacaggtttgtagcctaggagcaaaggctgtactgtattaacctaggtatgtagtaggctgtactgtctaggtttgtgtaagtactctatgaagtttacacaataacaaaatcacctaacaacacatttctcagaacattatccccatcatgaagtgatatatgcctgtatatacgtgatatgagaagttactttccaggacaaaattcttgttacagttactttctctaaacagaaccaaaagggataggagagtaaatgttttctatgggtaaaaggacaaagatttttttaaatgaggggtttctttctcaaaagttctatcttaacttttctccttatagtacaagagtagacacctaaggtggttggaagaaatggaaatactccttcatattttggttttacagccagcaaaatttcttattatatccccaccccaccctcacacccctacattaacatatttttttaagttacctgtaatgagggagccagaacccaccaaatgtacctcttctcacaccagctgaggctactttcttcaaacatttccttgcccattaccagaagtagtatactatatatgattgattgattttttttttttttttgcctcaaaactctctgaatctacaaaattcagttacctgaaagatcttcctttttgtattttcctgcatggaactgagctaagaaaaatctggctgaatttggagaagaaaaagtggtctgctgcagagaaacccaaaaggggagagtcggtggtggggtgctacacttggacaccagatttagaattgcctggaccatgggtcgtagtattcacagtggcttctctccctcaggccctctagggtgctgcagggagaaacgtttggccgcaatactctacactcacagtctctcagattttggctttgcagtgggatcttagagtcaattaccttgagagactatgtctcaatattcagaggccacagacttctgctaaaatgggctggagaagaaaaaggacataataacagatttgctctcaacgtttaaaagtgaacattatcaaagtgggcctttggatgcttgattacttctctctcccaacttggagctttatttttcccaattgcctcaggtgtaggtaattttttctttaggaaaatctattgacataattattaatttaggtttttgattgctctcctttgagcatcagcggattcctgtggacttaagagattgtacagtatcaatatgtgtctgcaacttcagaccttcacaaaggctcatctcatttccaggaggcctaaaactcttgggtgtctgtattaaaggttcatagaccctctagtatttctcatgatcatgctaaatgagttcaaactactttctctgagatcaaaaattaaaaatcaaagagatgtcagggttgtaaaccacaccttttcacattcaatggacaaaagagattttctgtgaaaatgtgaggttaatgacaaagaggttagtgacagcaaagggtggctaacacagtcatcagttggcaggtctagtgtagaaagggagggtgcagcagagcaggacaaagacttttttttttcttttgtggaaaattctcccacagattttcagccctgcaatcatagaactttagaattaaaaaggattttagtgattatctattccaaccctcttgtttcaggggttaggaactaaagcccagagcatgtgattggcccaaggccactacctttcctggttaactttcttaatgtctcttcccccatacttctgccaaaagaataatgtatatacagaatgcaccagtattacgtattgaacttaaaaacacattaaacttggtcgtagaaatctagaaccagctgcaaatgtttacttccagaagttcaaccattttgcaataaacatgcagttgcttctcaactcaaggcagtatattccattattaaacacgtactccataccaagcattatcttatacacattatcttattcaattcccacaataattctgttgaagttgattttttaattcccacctacaatgtggaaagtgaggtatgaagaggttaaatcatttgcccaaaatcccatacccagtgctgggattccaaccagatctacctgagccaaagccctcaccataaccatatcactaaaattgttctcgtatgtgccattctgttgatagaggtactttttgaggatgtttcaggcgtggcagggtagaaatatccctaaaaagctttatattattgtgaagttggtggtaaagggccaacctggcaatactaatgaggctgttcttcaaagacataggattcaagtgaaagtttctctttaataagaccattccctacaccctgggtgaagaggaaagagaaataaagatttgcagaattttggggcaagaagaaagattagaaagcctccccaaacacctcaataaacccatgagaaaaccacagcttagagaaattaagagccttgccaccatttctaggttaaaacaaaatgagtgaatgaattggccggcaaagagaagataaggcaattcacatttattgaacacttactgtgtaccaggccctgtccctgggtgctgtttgaatttcctttcctttcatctgtccccttcactgaccataaggttcatgagggcagggcagggatcatgtacattctctttagtgaagtatccttggtgcccatcacatggccatggtagatgctcaataaatatttctgactgttggaatacattaatgaatgaatcactcaccaactctagggggtcttaccatctcttacatctctttctctctgtctatccatatagatagatatagatacatatagatatatagacagatatatctatatctgttttatgagatagatatatatagatatctagatatctagatctatatatagatatatatctatagatagagattatatacctaaataggtagatagatagatggatacatagatacatagatctctagataaatctatttacatctctttctgtacatagatctgtctgtctatagcgagaggaggagatagatttctagaaagagagagagagagtgagccagtcttgctctgttgcccagggtggagtgtagtggcatgatcatagatcactgcaacctcaaattcctgaactcaagcgatccccccacctcagcatcccaagtgactgggactacctgagcttgccaccacacttggctaatttttttaaattattttttgtagggacaaggtctcgctatgttgcccaggctggtcttgaactcctgggctcacgcgatcctcccaccttggctttccaaagtgctggggttgcaggcatgagccagcatgcctggccgcatctccattttataaataagaaaaccaaggtgcagtgacccaaaacaacttacccaggttcatagagtttacctaagtcagttgattgcaaggtgcatagccccttgtatacatcagcacagaaaagctacatcaccaagctgataagcagatctgaatatcagctaacactggctctctcctgcctcttagcaagagctggagaacaaagacccaaatgaggtctgttagtcctaagatgttgttattattcacaatacatactgggatctacttatagtatgctgtgagacatcataagtaattaaaagagaactgcacatcttaaaataaatgagctctatacacttgaacatgaatgcagccttggccttccactgttttgtttccagctctctatgatgtgcaccttagtagtcattagtcaggagcaactgcaagattttcctatatcatgaaacatccaaacatttttcctagagaatctatgttatttcttggggctcgctgatattgtacattctgatattcataaagacactgtcaccaactgttagtggtgtcagcccagcattccttctcatccactttgatcatgttaccttccttcctttggaaaattataccctaacatacacactgtttatggttctgatggggccgtcaggcatattacactaaaccctggccagaactttgggtatgtgacccaagctcatctatccgaatcaactatctccctgatcactgtaattggtccagagtaggacaaatgcctcaagttaggcctctctgagactttatatatggctacctcttgacctccaaatcccatcctcctgccctgtcatttctaccaccaccgccatggccaagtagaggaaggctgtacgaagttaaaaaaaagtatcgtcagtgcatggcgaagctagggagaagagagcggagatgagagatgaggagaggagagactctaggcttgcaggggacagcaggagacagaagatacaggttacatgattttagtccctggaatacctgaagccagctcttctagtaagccagtgtttcctatgttgggtaaacacatttgcagtggtttctgtcatttgcagctaacagacatctaacaaattttctaatagcaaataggaattttaccacaggtttcaagggagagaggaacatgatggctaactttgtactgtgaattcattgcctgaggctggcagggcctgaacatcccacccagtagcagatgtgttgaggtagactgtgcttcaagctaagacttaccctttgtgtgcaaatcccaatcccatctatattccagtcaccacctcctccttgcagcctttcctaccttgcttttctctggttgttccaatctgcccaatgagtatgcactctttcccagcgcgcgcacacacacacacacacacacacacacacacttgttgctatcactttcctctctactttcctgaaggcggcaactaccaggtacagaaggtaatcattaaatcctcattggctgctcttgacccagctgaatttgtggtgtgaagaggatctaaggacagtgtcgtgccccaggcttctgagaaagaacctgtgcaggagagggacatagacatgggctctggagcctgatgatcacatctggctctgacatcgagccatgggatctcaggcaagtaagttacttacccccccacaaacctaagttttgatttctgtaaaataggaacggtaaccatcgttttgcagggttgtggtgaggagtaaaggtagtacatgccaatcacaccaggtagggggtgttccaaaaatgatagttcttgcactactgccttaactaaagacggccagatgattgatgggaatcttgtgggcactggagacataagttgtctggtgcagccttagatgaggaagactgaattacgaggtagaagccattattagcctcatgtctgtgctgcatcttcattttgcccctcttcttgtttactgttattctctaagtgcttgtttttgtttttgttttatgagacagagtctcactctgttactcaggctggagtgcagcggcatgaacatggctcactgcagccttgaacccccagattcaagcaatcctcccacttcagcctcctgagtagctgggaccaggtacacgcaccaccacgactggctaatttttgtacgttttgtagagatggggtctcgtcatgttgcccaggctagtcttgaaccctgggctcaagcagtcctcctgccttggcctcccaaggtgctgggattataggtgtgagccaccatgcctggcttctgagtgctttaagggtattccgagctatccaaggtcctccagctccaaagagcatgccatctgtgccttcgtaggcttctcttctcactgttattccaaccaacctttctccttgctcagccagcctaactaatgaatgaggcttctgtggttgcggttgctaaggaatccaccctcccaaatgtagttgcatcttagtgaggaccttttacagtcaaaatacctgaatccaggtgttttcaacattttcaccatctattacaccttttattattctctctcttgttgatgctatattttgaaatggatgtcttctcccaagggtaggatttgtttaataaaattaactttcccacttcattaattataggaatggttgccattagggcttaacccaagagcatgatacagtcaatgttaccacacagagtaagttaatttctggccaaaaggaaaaaaaatttgaagtactaattagcctgtttgtgattctggctgggtttgttgtaatacaacaaataattcaagtcccatcacaacctttctgaggggcacccctacctgaactcccccaaaagctgtcgcttcaggtagaggccctggagaggactggtccgtgagtcccttacctggtaggtggtccctgtttgactgttaccatttccagcccctctgctttctcctcaccagagctggcttttacctgagtttatctgggcctcagagtacaacgtaaaccgtgcagaacgatgtttctaactgttctacatacctacacattaccacacattcataattggacttgatttggccatgaaattccttaattctgactacatgttttctcccacccatgaggtttatagggggaagaacaactcatttaaataggcatctcttcctctgttctttttccaccctctgcccccaaaccaccactaccctagaaacctcccgctgcccccccagggcctagagaaggccctttaaggggataagaaatggtgcattttgtagaaagcaacctccaagctgaattaggtgaaagaagccattgttcttaacgcacatggtcaccagccacaggcctgtaaaataggcttagattccttcagaaaaggagtctctttgagcagcctagccccttctaactaggtgtactatcttcacctcttcttgaccctcatgaagttggttttctgtctacacatttttctgcttaggcgggaaaatatggctggggtggggaatctccgtttcagggatgtagtgccagaattctgagctgtccaacatttaccttgccctactctcagcatccctgtcttctttgggaaatctcactgtctaggtgggaagtaggctccatgttgtctctctcccactacggagccaccatggaacaaacccttgaaagagaccctgcctcgagagcagcctggccaacgtggtgaaacctcggctctactaaaatacaaacaaaattagccgggcatggtggcacacctgtaatcccagctactcaggaggctgaagcaggagaatcgcttgagcccaggaggcagttgcagtgagccgagattgcgccactgcactccagcttgagcaacaaagggagactccatctcaaaagaaaaaaaaaaaaaaaaaaagaagccctgccgagctggtgctcctcccagactcttcagccaaccaagcaaggagctgtggaggttggagaacaacagcagcaaggcctgtttgtattgcctggccctccagagtacccctggatcctgcctattgtccatgctgggttctcaaccctcccatcaattctatgattccctgacttccttccagtgaatttcctttttgcataagatggtctcagttgttcccaccctgtctagtggttaggggaaaaaaaagaaaagatggtctcagtttctgatgactacagtcatgaaccctaaatgattgtggtattatcctcaaggcgaatgaatcttctggacaagtagatataataatatctattattagtgcctctgttgccaacatttttggctctgtattctgctgtttattgctcacttaactaaaaagcttcacattctaatacaatgaattagaataagatggctagagaaagatcaggacaatatcagagtagggaacaaacaattctaaaagggtcaaagggtctagttgtgcaacctatttctcaacatagcacctaaacatcataattatagcatttggggacagctaaaatgattaattttccagaaaatatctgttgtttaattacaggatcatatgggtcttttggcaacgaacagatcccaaaacagactttaagcaccatcttgagaaacttgtgatttgcttagtgtgcttttaatttaaagcatatggtttcacattcaactgcagtgtccaaaatgaagacattagcaatgaatcactctattggagaaaacgcagtgctcctggaccaggtcttttggtctgtgtattcaaatggttctgtttagaggcataaacacaaagcagctctgcctgcttcagccggctgttcctgggattcatgagacatcaaagggcctcacgaacgaattcccctgcaatgcacagtgcttggcaccatggcctgcctccatctgaataaacagagtgcagtttggtcactggaaactacgattagaatgattagaaggccgaaaagatcatttattttgtgtgcaacttttcctttttgaatctctcagccttccagcttagtctgacacttcatggcccttggggaatccagctatcctgtgtggaaattcagaactgcagcctttatactaagaaccatgctatggctacaggccacagacccgagtccattgagaccacatgtggtctacctgctggtgagggatggcagtaaggacacagagtgtagttgtaaggatgtgggctctggacttacatggcccaaatttgtatgaacaagccatttcctagttatgtgaacttgggttaaggggtcctgggcttcagtttcagaatctataaaatggtaataacagtacaaatctttcagagttgttacgggaattaaatgaaattacccatgtccagagctaagctaagaatctagtacctcgtaagctataaaactatagttaaccattattgtaattctaattacaattattattagaaataggtccttcctctttgcctcaagtcctttcatgcctctgtttaaattcaatgcacatttaatgaagtgcctactgcaggtcaggcccagtgtgttagatacatacttctcagagtgctgtatggcttgaaaaatagcttttgtgtttctctgttcattttcttcagtgtttccacccatcctgtcttcatttcaccctacaagacattctccctcactcctcattgtgttcctagtcattctctatctctgtaccacccagtagtaaggactacatcaagctaaagcatagaatactgttcgtactggtagcacccatttgacaatactccaggcagttacatcaaaggagaggcatttcagaaggtgtatacaatctgttttattttccaaagagagctctgggtagaaaatctattactccccaagatttgtagtagctctttacatattaggcacagtaatctgttgtcaaatatagctgttacaagtattttctttctatttatcatttgtttgtttttaccgttaaaagggtttttttgccgtaatcccagcaatttgggaggccaaggcaggcggatcatttgaggtcaggagttagtgactagcctggccaacatggtgaaaccccatctctactaaaaatacaaaaacttagccaggcatggtggcgggcgcctgtaatcccagctacttgggaggctgaggcaggagaattgcttgaacctgggaggtggaggttgtagtgagccgagattgtgccactgcactctagcctgggtgacagagtgaaactccgtctcagaaaaacaacaaaaaaagttctttttgatgtgttcagctcaatattttagagtgcttgcccttagtctcaggcttagaaaaatctttcccaccttgtgattaaatattcacccatatttgcttttatcattttttaaattttttaatatttagatttaatacaaatatccttaaaatgtttatctttatctaggatttatctagaaaaaattattaaattcataagtcagccataattgttgattattttcccttcctggagatcttgccttgcttcttatggcagtgatggctctgggaaggcactaatgaaggaatgcaaaaatggtccactggatgtaaacaatagagaactctgaagataagcccttccttgttgttgttgtttttttttaactctgcaattattagtttattagtatcttctaggactcagatgttcagtattcctcctgaaattacataaacaaatccaaatggaaataatccaagtcaaaattacataacaaaacaacactccatcacaaaagcacgtaaaattataagaacgctattttagaatactggcacttcaagaaaacaataatctcgaaaaccacaaaattgccaaattgttccctaaactgctaggcagataaacgtgactaatgaatgagtttgggttttgtaaagaaaaatcattcaaataaattgaataattcatactgaaatgcaaagtttaagtgtcttccttcctctgatctacttggatttataaaggggcaaaccataatatgggaaaatataccctattttaaaagctggcccaattaattaaaaatacttttaatggaaagtctcatttcctgagcagtccatatttagataaatgggaaaagacatctatagccagcattttcatagtcttcactgagactaatgtccacaaaaaatttaatttggcagtcttatattctaagctcatgcttttggtgatacattctcaggtcttctttaatgtgggaactgcaaaatatcactgccattacatggtaatgggagttaaagaatagagtcctcatgtaaaggataaagcatacttttctattagtcctttaaggacagactttgaaaatgtttgcttctaataatcccatgctgtgagtagattgattacttatcagtttgtaaatataagtgggctatgcgaaatttcttaactgatcaagattttggattttcagttacagatgaaaactgtctcaacttaactttacccccattatgatatgcagggtgcatagacaaaagctttttattagctaactatatgaaaggataaacactgtaataattcatgtgattcaaaatgggcaaaagcttcccctcaagaagaaaaatttcagacctatgaaaacgacaacaatactaataaaaaaattgtatttacttcgaagcattcagaatgtcaacaaaacagctgccactttttattttgtaattacagagtggtattcagttaacagaacaacaattatttcatataagctgcatcagagacaactaaagatgaaaaactaccatccccatatataactaatttgtgctgtgcaccaacaagaacctgctttaaatttccatgccagtttataacccccatactgtaccaggcaaggttagtggctattgaaaataccaccaggacagggctatctaaagacacatttggtagtgtgttaactgtacaaaaaaagacactgtacagtgtaaaaacaaatcttacacagccttacattttaatttttttatttaaaaggagtgagttgtgtacaggggggttaaatgctttatagacaaggaaaaaaactaggctagaaccaacttattcatcatcatcttcttcatcttcctcctcataatcctcttcatcttctgtcctcctcttccttctttttcttgcttttttcagccttgacaactcccttttttgctgcatcaggctttcctttagctcgatatgtagctgtatcctttttgtatttttccttcagctttgcagccttcttttcacaaagctgcttgtcatctgcaaaagtgttattccacatctctaccagtttctttgcaacatcgctaataggcaggccaggatgctctcctttgatttttgggcaatactcagagcagaacagcaaaaaggccgaaggaggcctcttgggtgcattggaatcctcgaacttcttttttgtctcccctttaggagggatataggttttcatttctctttcataacggtctttgtccacctttgccatatcttcaaattttcctttatctttagcagacatggccttccacctctctgagcacttcttagaaaactctgagaagttgactgaggcatctgggtgcttcttcttacactcctcccgacaagtttgcacaaaaaatgcatatgatgacattttgcctctcggcttcttagggtctcctttgcccatgttgagttatttttcctcagcgaggcacacagtcacccagtgcccgtccggctctcacttgccccggcactgtctctgtggagctcaatgtactgcagtggctgtgagagtgggagccgggcatagcctcctcaccctctccactctgtaacattaaccttccttgtttttatatagtttaatgatttgtagcaatatactttaatagcttagccttttaatttgggttttctgctgcacttataacaaagttttgaatgcagagtgaatcactgttaataggatttgtcttctcaagtgtgctagggcaggaaaaaaagttaaattcactcttaggtcctttttactttttgcttctgctgttcccattccagccaaggctttcctcacctcagttggactattataatgtcctttttgattctcttctttccctctctcctctaaattattctgcatgccactgccaattactatatgtcatcctcctgatcagaagctccagcgtctccccagagcccatgggataaaagacaaaatctttaagaatgacttctgccaggcgcagtgactcacacctgtagtcccagcactttgggaggccaaggcaggtagatcacctgaggtcgggagtttgagaccagcctgatcaacatggagaaaccctgtctctactaaaaatataagattagccaggcatggtggtgcatgtgcgtgtagtcccagctactcaggaggctgaggcaggagaatcacttgaacctgggaggcagaggttgcagtaagccaagatcgcaccattgcactccagcctgggcaacaagagcgaaactctgtctcacaaaaaagaaaaacaaaaaacaaaaaaaaacttctaaaccttcataaactttattttcctaaaatctccacttccctgcccctgaaatcagtggtgatactaggggaaggcctgtgggcactttaagcaccctcagaatacgttacttaggtccatgaaatccacgcccccccaaccccatagaagtcttagtattgtttgaagtggaaaatattaattgtccatataagtgtgaaggaaagcatctttaggaaacattgctattttgaaaaaaatctagtggcatattatctaagaaaatacaaaatactatgcatttgctatataagccatttgatagcccataaaatatttattttattctaaaagattgtttttctaaacgtcttaaaactttcgtatttttttctcttctcattattcctgtggcattgattagtgtcactgatatccccagatttcatagatgaaggagtcacacaaacatcagccaccttttttttactacaaaacaggaaaacagtagttattcccaatccaacagtctttgggatttaggatgacagttgtctacttcatattggttaaaggttttgtgtgtttttaggcaaaggttttgtgtaatcattcaagaaaatttttggtttggttttaaaatgcttaggaaaacataaatattcatcagtagaaacttgttaacataatggcacatccataaaatggaatactatggaaccatgaataagaatgacatagctgtatcatcatggaccacataacaatgttgtgatcaacaatgaaccacatataggatggtggtcccgtaagattataataccatatttttgctgtaccttttctaagtttacatatgtttagatacacaattttttaccactgtgttataattgcctacagtattttgtacaggaacatgctatacaggtttgtagcctaaaaacaacacattataccatatagcttaggtgtctgatagactataccatctatgtttgtgtaagtacactataggttattccaatgaagacaaaattgtctagtggcacatttctcagaacatatccttgttgttaagcgatgcttgactttatgcaaaagcctccatgttatattgaaatatgaaaaaagcaaagcacagagtgtgtaaatatgctcacatttgagggttttgtttttatttttatttttgttttacaggcaggagatgtagccttagaattgtatgtatatagaatagttcacacaaggtagtgatggcaacagtttcctctggagcaagggctagggttctggggaggacttatttattctataatcttttgtgctatttaactttttttctttacctaaagtgtgtgaattttttcaattaaaactgttaattaaacattttaaaaataaaatttataatgaaattttaccctcatttaatgacccttaagctaagagggaagtgaactgtatcaacagatacagaagccaaataggtcagcacttctgagttagagaggaacaataattctttctgaaataaaagaacattcttcagtgactgcatatcattcagaacttaagcaacaaaaaaagacaaagtagggatagaaaagctataataattaaagcaacccaaacaatttccttccagaaatgtgggaaaagaaagaagagaaggtgacccttaaggaacatggtatttcagaaagaggccacacaatgcagttgtgcacatgtatagcaagttagctagttctcaagtctccatttttgctgatggtagaaaacaatctggtagcttccaggtaaactcagtcacttccaggatttttcacagtctctctttaacataaacactcagttaatttaggcttctcctccctcacccttcttctcttatccccttcttagccaaattttaaaacattttttactgtacctgttatctgtatttcccactagagaacccctttgggtcctaccgctctcctgaaacacattatcagggttgccaaagacctccaggttgccagatccagggcatcttctctgtccttttctcattccgcctctcagcagcatttgacaaggctgacccatggttttcttaaaccactctcttctcagcttctgtgaagactcacccttctggctttcccccagcctcatggctgctctttgtttcctcccaaacctctaaatgccaggggttcctcaggcatcagagaaccttttttcttctccctttacatttattctccaagcctgaaattccagtgatgtgttgatgatgccccagttcatatgtccagcccagattgtttctctggatttcagacacacacagagcttcctacttgatatctccactcagatgtttccagggtatcctgtgcttagcatgtccagaactgaactcttgatcccctcatgtcttgaaaaccttagtcctcccttggtatttcctgttttaataagtggcatcatgtttggccgggcacggtggctcacgcctgcaatcccagcactttgggaggcgaggtgggtggatcacctgaggtcaggagttcaaaaccagcctggacaacatggtaaaaccctatctctactaaaaatacaaaaaaaattagccaggcttggtggcgggcgcctgtaatcccagctactcgggaggttgaggcaggagaattgcttgaacccaggaggcagaggttgtagtgagctgagatcatgctactgcactctagcctgggggagagagtgagactccatctaaaaaaaaagaagtggcaccaatgtccacccaaggatccaagccagaagtctggaagccattcttgctggtctcctttccctcattttccacatccagagcatcaacaagttctgttttgaccttctgaatacatcttgattttgtccatttctcttcctcttcactgccacaaccctggtccagataaccatcacctctgacctgtagtagcctcctcactggtcccctcacttcccctttgtgtcagtacgtatatgggactcccagcagagacagtgatcagcgttgaagaaataatctgcttcgtgtctttttcttcacattttccttccatagcttcccattgacttaaaaaaaaaattcaaactgcctccctggccatcaaagctctgtatgacatgtccatactccatttcttcagctttacctcacatcatgatccccttcctcactacattctagctacactgggcagatctgatctgcctccgggacatggagatgccatttgcattatgctgtcccctcagcctagaacacttttctcattcttcaggcctcaaccatcaactcttcagagaggccatcatccaccaccatatccatgagttccttttactctgtaattttgacttaaaacaatctattcatttcctagcctgcaattattgtttatagttgaactccatcactagaatgaatgaaatctccatgaaggtatgggtcatgtctgtcttgcccacctaatacattcctagaaagtgacacatggaggacattcgatcaatgatgagcattgctgtggatttaggaatgcgtaaatatttgcaacattttctctaactctgctatgatgttccttataaaaataaaatacaggccgggcacggtggctcacacctgtaatcccagcactttaggaggccgaggagggcagatcacctgaggttgggagttcaagactagcctgatcaacatggagaaaccgtgtctcgacagaaaatacaaaattagccaggcgtggtggcacatgcctgtaatcccagctactggggaggctgagggaggagaatcgcttgaacccaggaggcggaggttgctgtgagcccagatagcgccattgcactccagcctgggcaaaaaaagcgaaactccgtctcaaaaaataaaataaaacaaaataaaataaaatacaagtaataaatatactcttctcttaataagtaattatcatctgggaggaaaagcattcatgagtagaaacttatattcctattttctcagttataataagtcaaattgtatgagattgttgctattagatagtttgttactaccaaacaacaatttcaaaaggtacaaactaataaagtgtacatatttagtttaagctgtagtatcagttgggatagattagattatgatgcagaaataaacaatccccacaacttcgtggcttacagccacaaaggtttctttcgcatttgtgctatactacatgggtcagctgcggctctgctctgtgtcctcttcactccagaccccaggctgatatagcagttttcatctagatcatcctgggggttatggcagagacttggcaaaccacactctagtttctatctacaaagacacatacccttttggcccacatttcactggccaaaggaagtttcatgaccattcctgaattcagcagtgtagagaagtgaatctttctgctgggagaggcacttcagggataggaacacaaatatttagtgtaaaagtaatacagtctatcacagttagcctgagcagctactgttttcacctggtaatagctagctacattttagttattaatatatatcctagcagtaaataggactaggcttatgccatttagcctattcataaatgcaatattatgtggtaaaaatacctacattagtgttctgacctgtatttagcattttataataatgtaggtttcttttatttagtagacgctctaggtaaaggaacaaagcttgtagaaatcaggaattctaaagtataatagaaatccctctgctttgcttgttgatttgaaagatatgttttgtgaaggagaagtaatataattaggggtcactgactttcgatgttctgttttaagtttgtacacttttaaggatacctatagacaaaatccagaaatgcttatgaagttgcctgaaatttggggacaggtacacttctggaggtttcctattctaagttaattccgtgatgtaaagaatagttacaggcgaggcggaggttgcagtgagccaagattgggccactgcactacagcctaggtgacagcatgagactccgtctcaaaaaagaatagttacagacgtcagaatggtttgggagcatatgggttctggggtaattttattacttacttgctatgtaccttctctttctacaagatacagatatttatatgtaagtgccacagacttctgagtacagttcatgggcaacaaaagaactgataatcaattaatagacattaaaaggatggtgctttgtaagcattactttgacttcccagtgggattatacaagattgaaggatccaaaaggcaaccaagagaagttcccattaatgataaacagcatttctcttatcccctcctttgcttctccagaggtggcacttcagattcttgttaccgtttacatgtcctttgcatagatgtgctcagaacaacatcacccaataggaaaaaaaaaaacatacaactttgctcgtggtcccagtatgcttcagctggcttattcaagcccaaagagagagagagagagacagacagacagacagacagagagtatgtgtgtgtgtgtttcagcacttccagcctctcatgaaattaaccattgatctaaaactgagagatgcaaatccagagaaaactggaagcagtccagggcccacaatataaagttaattacctaaggaaaactacaagaaagacttttgttttccatcaaaatctcctccccaggctgttagctatgtcgtacataggcccaatcgatatattagcgcttgagaaccaaagtcccttggaataaattaatctgtcagggaaagaaataaacaaagaacaagttaacatgttttaagacattgcttaaattttcataaatacagaccttgagatgggatgatgagttcccaggagccaaagctaatatttggttgtaattaagagttgctctttcatgtttcttctgatgtaggtgggaaatcacccacgtgcttgctgatttccttgcccatgttccttcacaaatgccactgtttacttcattaatgagaaatagatgcctcacacattatactggcatacttagcttgtttcacctctagctaacattaacataatggaaaactgtacacaaatatacacactcacacatatacataccacacacacacgtacatgtcatacaagcaggtattccttcaggaatcgccatacatttttagtggctcaaaaggacctaatggcctaatacatgatgtactagacccatccaagatgttcataactcagacctctgttgctaacaatccctatgtgcccttcactgtgtgcaggtgtggagggaaattgctgatgattagcaggaagagagacaactatgtaagttacttatgtgtaaggactcatttaaatacaagaaccagaaaaaaaatctatctcaaactagcgtagaccaaaagacaatttattggggtccaatgatgtcattaggctgctgtttctttctccctatggttcaatgctgcttattctcagcaggtgacattatcagtgctggtaaggtggccactgccagccctgagcctatatccatgaagtagaactcaagatcccgaaagacaaagggctgttcctcttccagtgtccatatctcagatctcctagaggaacttcagccctgcctgggtcctgtgcccactcttgaactaatattaatcactctgggtggggaaaggggggccaggccctggccatgtgttcaaattgatttggaaagaggcagactggggagatcagccacatccaaatgcctgcaaaggaaagagaagactctcaccacagcagaggggtagagatgttagacaggtcaaacaaccaatgcccacctcaagaattttatttccaaggccaggcacagtggctcacgcctgtaatcccagcactttaggaggccaaggcgggtggttcacgaggtcaggagatcaagaccatcctggctaacacagtgaaaccccatctctactaaaaatacaaaaacaaaattagacgggcatggtggcgggcacttgttgtcccagctacttgggaggctgaggcaggagaatggcgtgaaccccggagggtggagcttgcagtgagccgagatcatgccgctgtactccagcctgggtgacagagcaagactttgtctcaaaaaaaaaaaaaattttatttctagtgtattcatcatgttcaattgctgaatgagctgatttacagaagaggccaagatagagatccttatgtttacatagcaagtccaagctctgttaacaaaattgattaccctctatcaggcagtcaagtaattttctatcaagttctaaacaaaaactcactataggcctttaaaagctgacatgagatacctacatatgtttcttttcccagttatggtagctttctcaaatgaatttaaataacttcctacttcccactacatcctgcttgatggaatgtatctgtgctaattatcttattacttactattactaaagcatacccaggaaaaaccaacagagtacagtactttttatcagttgagaacttttaaaatgctaatttctgtgattgcataatttcataactcagcactcttgaggatttcgcatttgggtagtagatgaaatttgaattgtttattttgatgtgagatgcttgttctaattattgagcaatttatatattgtgaagctagtttatataattctcaatacatggacacagagctggaaatatattaatattctccaaagctatactatcatggaaaagagaatagtctctgaaccaagtagttgcagatccatgagaccagaggagccgttgagtctgttcttttcgggaagcaagataagcatggctggtgctttattaacctccatgtaggattcagatttaccccagtgaaaggcatggcaaattcatcaggactacaaacaaaccatgttctgagatggatgggattagcaggtcagccccctcggcaactggaggggcaccacctagatccttatgaagcggagatttggcagattaaaaacactctgcctcaaaattacttacataacatccatcatgtagaagcagtgtgtttaacccatgattggggtaatgtttttaagtaaatattctatcaacaatgattgggcttttttgtttgtttgtttttttaaagggcaagggccagagtcattttggcaaaatagaatccccaaagaccagcccctggaataacacttattgcagcaaagcttcacgtaaaatttgtaaaatgggtatgaaaaaaaatttgcacaaaatgcgggtgttgaggacagtggggacagtggggacagtgggaattctacagattggaaatgaaatcaggagtagttcagtgttttctccttgaaagttatattcctggggatgggagaggaccaggcaggagaattcaaaagcctcctactactgcattcaataaaataaaaagaagacagcatgttaaagagactagcaataacatttcataaatctttgaaaatagcaaccatgggtatagcacaattaatttctatacaccatctctttttcatagggaacttgtcagtttctccctccctagagcttcagtgaggagtttatggctttattttgctttgttacaagtgaatagactgaagcagggtttttcctcctgtgtggacctacatccaaatgtaggaacttcacagatcaatttttgaatcccatttcctccttggcccaaaaatgcttctcaaaaaatagaaaaattatgttgtctgtagtatcctaatggatctccaggccagttctcagggacactgagtcctattcatagaacaacagtggactgcctggccacaccttcccttgatacctgggcatgataggagagcctggactcagccaccccttccctaaaaatctgcactcccaccagttagcataaactaatgcattgtcttgtctgtcacctgttccactctttggtccagctcccatgaacccaaacatttcacaggaaagagcatgacagggcaggccaaccctggtggtgcaagggccattcctagtgtgtgtctgcattaaggggtttatgtgaggtgtcatcagatcttgggaaaggaagcttggcagcgccagtgctcagggccttatggacagcagggctagtcattgtgccctgacctatgattcctttttttgtgtaaataacctctatcactttctaacattctatatgccactcttacttattacccctattgtttattgtgtctgcccctcattaactgctaaactccataagggcagagatctttgttcactaccacatccccagtgtgtagaacaaagccaggcacagaataagcactgaataaaatcaaatgagcaacaaggaacagatttcaccatcagggagaaaaggagtctgacacgctgacccacacgtaacagtggaggcaggagttagagggagtaaggattctgggtgcaacatggcaatggatatttgcgctcattttaccttacctagcctagtgcaggtattgcatggaggaagagaccatgcttgtgaactagagagaggctttgttaaattccctaatacttcaggacaagcaaccttactgtgcagctttcttagcagagcatgacccacggaagatgtctcctttttcactttagaaagactcaagcactgtctttttgaggactataagctctcacagattgggtgcatcagaagcaatctgtccctggtaagtggggaggcctacgcggagcactgggaccaggggcaacactcagcttagggtgtggactggccatcctgagcaggcgactctggtaatgcggaaagcagggccatactccagtctctctcaccacccacctggagctctgcaggaacttcccagctaccctccagctttcacaaactattctgtgtaccaacactagatcatctctattaatctcactcactctcagcaatgacttttcagaagcatgaaaacaacctcccatcaacttctggtttggagtgctgaacacaattcagcctgccagctcttagttcccacccctacctgcaatccaagttcacactggcactgatgggacttcacagaagaggttgttccatttgatatcttaagtctatgttgaactctgacgcacacctcagtccttccatcctctacccagagcatccaagctccacattaatccttccttctctactaccacacctgagattctaagcactactgctaaaaagcatattaatgcagattgatgccactcacaaaatcatcatctctagtcctagctgggcctataacactctcccaagtccgagtcctgtgatggttaatactgagtgtcaacttgactggattgaaggatacaaagtattgatcctgggtatgtctgtgagggtgttgccaaaggagattatcatttgagtcagtgggctgggaaaggcagacccacccttaatgtggatgggcaccatctaatcagctgccagtgtggctagaatataaagcaggcagaaaaatgtgaaaggaagagacgagacaagacgagcctcccagcccacatctttcacccatgctggatgcttcctgtcctcgaacgtgggactccaagttcctcagttttgggactcagctgactctccttgctcctcagcctgtagatggcctattgtgggaccttgtgatcatgtaagttaatacttaataaactcctcttaatatgtatatcctattagttctgtccctctagagaaccctgattaatacaagtcccgaacaagctcccactcccatccccttctgcattctatttcaagatttcatccctctcttcaatcctcgtgctctctctcccacctcccctacccctagggtgtagtagaagcaatggggcataacaaagggggcatggactttggtgccaaatgaatcctggctcaactctctgctgcttagttggataaacctaagtgatttatttttttctgcaaaatgaggataataattctcaccttgtaaggttgctagagtattaagtgagataatttatataaggcatccagaatgccacctgacacaaagcacactactcaacacatagtagctgttatgatggggatcatcattgtctgcagactatctggattcctgggctctctttggagtagagagaggctgcaaggtaggaactccctttacttcctactgggatttccaaatgttaaatccagctgcacccatcatgagctgaccctgccatttccacaaataagttgctcttccttctctcaccagcacttactcctctttgctgtgctcttaaccagagtttctcaaacttaatgcactcacagatcatctggaaccttaatatcagattctgattcagtaggtctggaacagactgagatcccatatttctgacaatctcccaggtgatgttgatgctgctggtccaaagcccagcatctatagcataaggctttctatcaatcacattctgtcctgctgcaccaaggccacaactcccctcagtcctgactctcagagaattcacaggccctatctcttctgtctttagaaagttccctcccagcatgagccctccacctgttgctctcttctccactcttcacagcctcattccttggaaggtaactcttactactggcccttcttcacctccccctccctcccttgctcactaatctagcttttgcctccaacacagtcttgaaactgatgttatttaatgtcacagttactttctgtttcttacattaaatgacctccctgcctctctgtagcattcactactgtggagtccctccctttgtgtttcggtgtcacactttcctctgttttgccccctgctctctgatcctgccttcacatgtgactacacttgaaaatcccacaggtacctaaaacccaacatatctagctctagacgtatcttcctccctcacttcaccacacatgtttactcagtacctaccatgtaccaaacccacttctaggcactgaaggaaaagctgtaaacaaaacaggcaaaaatccctggcctcatggagctgacaatgggaaagtcagacaagaaagaaaatcacttgtatagaaggtgacacctacaagtcaggacggagggatagggtgtgctagaggcacaaagctgtctgagaaaagagctttctaaagagggaatggccagtgccaaggtcctgaagtgagagcaaagctggtatgttccagaaacagcaaggaagtcagtgtagacagagggaagtgagtgaggggaggaggaggaatgtattcattatctattgcttcttacaaattacaccaaaacttagtggcttaaaacggcaaacatttgttatatcacagtttctgtgggtcaggaatctggacgcagattagtattgcaggatctggtcagcagcccacaatgcaatggggctctctctttgttcccaggtgtattggcaggttgagaaataatagacacacacaagatagtgaaagctgggtccagggggttcactgccttccggtcccatggtgccaacaatgcactggatataccagcgtttattattaagtttagtgagggtgggggtaggttagtgagggatttagggtcatttgattatgaggtgagatggtcacatggggatgaagtaattctttcacataacatttgtatgtagaagtacagtacatttgtatgtagaagtacagtatagagagataagaatttacaatatagtgtgtgtgtcagtaatttctaacagagccttaaaacagaaacacaatctttccataacctatgattagcaagatattaatcagcagtaacaattgcaacaaaagctggttacaaacaatccatggaaacaggacgtgaagctagacaaccggttagaccagaaattcccagaagggagtatgccttaaccctaaagaggcctagaagagctgtggcaagatgagggcgtttatagccctatcttatccatacggacagccacctccccatgcatccgtttataggctctccacaagggtcgcattccattcctagagctatgaacatctgcctttctaggataggaatcttggtgatgtgaaacctccctgactgcacgtccattcataggctctctgcagggggaatcacatcacgtgcagttggctcattctggcagtccaacctggcattgtctttacacaatcctgcatgcaactttgtatttacaataatcaggagcatttcatcttttattccatagcaacagtttcagggggtctccttacatctcccccttctctctgatttaaatgaaccatagcaatcatagcttggcactgatcacaattggactgaagaatattttttccaattttacacatgaacaataaaccaatagtacaaattatacacagaacaaaattaacgatagtggatcctcccaaagattttacctattgaatggggttgagattagataatccctcagagataccgtctaaaacttcagcaccgggtaaagcagttaagtgtgcttgagaggcctcaaaaatctgttcttttagtttgcttatgtctaaagctttaaattatcttcacttccttgtaaatggcattttactgattcccaattgtgaacagactcattatattgaaatggagttatacaaaaatcagaagtattccaatcacattgcatttgtaatctatgttctaaactcataattctacctcccatccatataacagtttgtcttagatcattaatttgattagccaatttttgatcaatacctgagaattccacatccgagtagaatttttttgccatttatccacaaaatgaacagtttgaatagatggacgtaatgcaactccagcagtagcagcaatcacagtaacagcaatcaagcccattattattgcaattaatgtaaaaataaattgtttactccttttaagaattttctatagaatattgttaataacatggataaagggggaagattcccaaggcctatgtaaggctacagggagccaaatatcttgtctggctctgactattaaaatactatgatattgattaaaggatgagtcaatacaagtatacaagtaacaattaacacaggtaattatgttggtttttgaactaatatgcaactttcctgctaataacatatatggtggtttaacacaacttttaagtggtatagttttgttggactccatatagagagtatatacattttgaggtgacaaagtggatttacttataacactttctccagcccaaactctcataccagtcatagctattgttaatctccataatttggaatgttcaggtcctatgtggggaacaatgagccttggctttggaggcgcaacccctgcccctttccacttaagaggaaaaaaggagttaaatctacgatataataggggagggctgtcactacgtttttgataagtaatattatagagaaaatgttgacaatctctgtgaccttgagagcaatcattagtaatatgacctttaggagcccaatcaacaatggtgtagtgagaagaattaaataacacggttccttctgagctaacacagtctttccatattaattttgtcagcatttgaagacaagttgagaggacacacaggtctaaaggcttatattgggatgtgtgaatataatcagtgattactgttttgatctgccttagaggttttaatgagagccctgatatcaagtgtcctaaaggagggacagagtgaccagacggtagtgtgacagcccaagtttgaatatctaatgagagacatacattagtgggtcccaggcagaaaggtggatacctaaaacctaaagtgatattgaaaggggttccttcttctgaaggttgtgcaggacaacgatcatctagagaaccaggcatccaaatactatcattaacatagacctcgataggagcatccatccatgtcacggctcgaataagaggaggaaaaggaatataggcccaatatgtatagtttttaacagtctgtggcgtaacagaggtagaaggatcagtgtcatcaggaggaggcagaggttgagccagacctggatcgctggagacaagttgttcaggatggctgtctggattgtctgttgtaaaggagttagcgtggtcttttcttctttttgatgattggatgtgttagttgtttcctgctgtggtgctttttcagcaaatttctctgtctcgttgttgcatgcatcttcaggatctggtcagcagcccacaatgcaatggggctctctctttgttcccaggcagatcagcaggttgggaaataatagacacacacaagatagtgaaagctgggtccaggggggtcaccgccttctggtcccatggtgccaacaatgctctggatataccagcgtttattattaagttaagtgagggtgggggttggttagtgagggatttagggtcatttgattatgaggtgagatggtcacatggggatgaagtaattaacataacatttgtatgtagaagtacagtacatttgtatgtagaagtacagtacatttgtatgtagaagtacagcatagagagataagaatttacaatatagtgtgtgcgtcagtaatttctaacagagccttaaaacagaagcacaatctttccataacctatgattagcaagatattaatcagcagtaacaattgcaacaaaagctggttacaaacaatccacggaaacaggatgtgaagctagacaaccagttagaccagaaattctcagaagggagtatgccttaaccctaaagaggcctagaagagctgtggcaagatgagggcgtttctagccctatcttatccatatggacaggcgccccacccccatgcatccgtttataggctctccacaagggtcgcattccattcctagagctatgaacatctgcctttctaggataggaatcttggtgatgtgaaacctccctgactgcacgtccattcataggctctctgcagggggaatcacatcacgtgcagttggctcattctggcagtccaacctggcattgtctttacacaatcctgcatgcaactttgtatttacaataatcaggagcatttcatcttttattccgtagcaatagtttcagggggtctccctgcagcttagctgggtgcttgtggctcaaggtctgttgtgaggttacagtgaagctgttggccagagctgcagtctcatgtgaagtctcagtttggggacgagggttggggatccacttccaagctcactcccaaccacgtctctcaccacatgggactctttacaggactgcgttaccatgtggcagctgtcttcccctggagagagtgagagaaagcacacaagatagaaaccacagtctttttcaaacctcatctctaaagtgatggcccatcactgctgccatattctttttttttttttttttttttttttttgagacagagtctcgttctgttgcccaagctagagtgcggtggggtgatctcagctcactgcaacctctgcctcccaggttcaagcaattctcctgcctcagcctcctgagtagctgggattacaggcatgcgccaccatgcctggctaatttttgtatttttagtagagacagggtttcaccatgttggccaggctggcttgctgccatattctgtttattagaagcaagtcactaagcccaaagagaggtaattaaacagaatgtgaataccaagaagtggggatcattaaaggaccaccttagaggctgtccaccataatatgaggtaaggcttataaggactttggcttttactccaagtgagatgataaatctttggagggtttcaaacaaacaaacaacatgatttctttgctttttccaaaccaaaaaaaaaacacttcttccttaagaatttcatacaaatacctcagtctaacattccaggcaaaactccactttgcttttacagactgtacttccatgacacataacaggctgaggccaattaataagagtttactgtactggttaagagttcaattctagagacagagtgcctgagctggaatgtcagctcctcttccatttattaactatattaggcaagtcatcaaatctctctgcctctttctctatagatagtgacaataattgtacttttgtcaagaactgcaaagggtctgagattttaccctgcttgtaggctaacaagttagcctgccccatcttcacagaaactagcagaaggcatgagattcccatgtcagagacaaaagacttgattattcacaagacagtaggcagcatgagcttcatgttcccattggttacccttgtccccaaatcccatggggtagatggaaaatggcccgggtagatctgtgcacacagtggatttgtgtcactgttgaagaaccctgagcttaggaacctttcagtctcgtaacaggctgcagcaaggctgcccaccctttggcctagagggagacattttctttattatcctagtcaggaagcgactctgtcctctgcattggagaaagacatgatctctagcctctcagggtgtttgccatacaaatttttttttcttttttttagttggagtcttgctctgtcacccaggttagagtgcagtggcgggatctcggctcactgcagcctccgcctcccgggttcaagcgcttctcctgcctcagcctcccgagtagctgggattacaggcacccgccactgtgcctggctaatttttgtatttttagcagagacagggtttcaccatctcggccaggctggtctcgaactcctgacctcaagcaatccacccgcctcggcctcccaaagtgctgggattacatgcatgagccaccgcacccggccaaccatagaaatatttttgaaaagatagtccaggacaacagttgtcacatatgtatagaaacacttggagaactgctccccaggaggttacttcataggtttattttatgttttattcaatgagttagttcatatggagtatctggtacatagtaagggctcaataaattattatgacacccttctaatataacacctttcttcaggcaagttacaagatgctcttccttcccacctttcacacatattttaagctccatattaaatactacaacttatatgaagccttttcttactaccaactggaaatgtttttttgtttttttgtttttttgtttttgagacagagtctcactctgtgcccaggctggagtgcagtggtgtgatcttggctcagtgcaacctccgcctcccaggttcaagtgattcttctgcctcagcctcccgggtagttgggactacagatgtgcaccaccaggcccagctaatttttttgtatttttagtagagatgttatttcgtcatgttggtcaggccggtctcaaactcctgacctcaaatgatccacccgcctcggcctcccaaagtactggggccaccgtgagccaccaggcattagccaccatgcccggctagaaatgacctttataatctgaattgtgtacctgttttggagcacatgtcacattctgccatgtattaccatgtacctgtttttcccacctgtcccctagattttaaaccctttgaatgtaggagctgatcttacccttgtatttgctttgcatacaactgaccctcaggaagtaatcttgcaacttggcagttgttctcaaccttcatttcaaaagccaaaagccaactatttctacctttaaatcggctccacccttctaaatactgagaatctaaatcttacatcctttacttatatagttctaaaaagaaaaatgctcaagtttcaactttcatgtaagaaagcctgaactacttaatgttcagaaaatcagtaatttccaatgttgcagtgtggctaattgttaaggttcctaaccctagcctactgtacagttttgaagctagaaattgtgccttaatcctttcacaatgtgaggatatattaaaatatcctcaattagtgcttatttgaattagaaatgaatcaaaatgattttctgtcctgagaagagcaacttttaaatatcatataaagtgatacatgcttgcttaaaaaacaagtaaaaacttaaaacaatacaaaaggaatacagtgaaaactaccttcctcccacaagccttaccccaagtccctgttaacagtttcttatgccattaatatgcaaggaaataaatatgcacattcttacattcttttataatatacatttttttttattattatactttaagttctagggtacatgtgcacaacgtgcaggtttgttacatatgtatacatgtgccatgttggtttgctgcacccattaactcatcatttacattaggtatatctcctaatgctatccctcacccctccccccaccccacaacaggccccggtgtgtgatgttccccttcctgtgtcctggtgttctcattgttcaattcccacctatgagtgagaacatgcggtgtttggttttttgtccttgtgagggtttgctcagaatgatggtttccagcttcatccatgtccctacaaaggacaggaactcatcattttttatggctgcatagtattccatggtgtatatatgccacattttcttaatccagtctatcattgttggacatttgggttggtcccaagtctttactattgtgagtagtgccgcagtaaacatacgtgtgcatgtgtctttatagcagtatgatttatattcctttgggtatatacccagtaatgggatagctgggtcaaatggtatttctagttctagatccctgaggaatcgccacactgtcttccacaatggttgaactagtgtacagtcccaccaacagtgtaaaactgttcctatttctccacatcctctccagcacctgttgtttcctgactttttaatgattgccattctaactggtgtgagatggtatctcactgtggttttgatttgcatttctctgatggccagtgatgatgagcattttttcatatgtttgttggctgcataaatgtcttcttttgaaaagtgtctgttcatatactttgcacattttttgatggggttgtttgattttttcttgtaaatttgtttgagttctttgtcgattctggattttagccctttgtcagatgggtagactgcaaaaattttctcctattctgtaggttgcctgttcactctgatggtagtttcttttgctgtgcagaagctctttagtttaattagatcccatttgtcaattttggcttttgttgccattgcttttggtgttttagacatgaagtctttgcccatgcctctatcctgaatggtattgcctaggttttcttctagagtttttatggttttaggtctaacatttaagtttttaatccatcttgaattaatttttgtataatgtgtaacaaagggatccagtttcatctttctacatatggctagccagttttcccagcaccatttgttaaatagggaatccttttcccatttcttgtttttgtcaggtttgtcaaagatcaggtagtgtagatgtgtggtattatttctgaggcctctgttctgttccattggtctatatttctgttttggtaccagtaccatgctattttggttactgtagcctcgtagtatagtttgaagtcaggtagtgtgatgcctccagctttgttcttttggcttcagattgacttggcaatgtgggctcttttttggttccatatgaactttaaagtagttttttccaattctgtgaagaaagtcattggtagcttgatggggatggcattgcatctataaattacctagggcagtatggtcattttcacaatattgattcttcctatccatgagcatggaatgttcttccatttgtttgtgtcctcttttatttcgtagagcagtggtttgtagttctccttgaagagatccttcacatcccttttaagttgcattccgaggcattttattctctttgtaggaattgtgaatgggagttcactcatgatttgtctgtctgttattggtgtataagactgcttgtgatttttgcacgttgattttgtatcctgagactttgctgaggttgcttatcagcataaggagattttgggctgagacgatgggactttctagatatacaatcatgtcatctgcaaacagggacgatttgacttcctcttttcctaattgagtaccctttctttctttctcctgcctgattgccctggccagaacttccaacactatgttggataggagtggtgagagagggcatccttgtcttgtgccagctttcagagggaatgcttccagtttttgcccattcagtatgatattggctgtgggtttgtcataaatagctcttattattttgatatacatctcatcaatacctaatttattgagagtttttagcataaaaggctgttgaattttgtcaaaggccttttctgcatctattgagataatcatgtggtttttctctttggttctgtttatatgatggattaagtttattgattttcatatgttgaaccagccttgcatcccaggaatgaagcccacttgatcatggtggataagctttttgatgtgctgctggattcggtttgccagtattttattgaggatttttgcatcgatgttcatcagggatattggtctaaaattctcttgttttgttgtgtctctgccaggctttggtatcaggatgatgctggcctcataaaatgaattagggaggatttcgtctttttccattgattggaatagtttcagaaggaatggtaccagctcctccttgtacctctggtagaatttggctgtgaatccgtctggtcctggactttttttggttggtaagcagttaattattgcctcaatttcagagcctgttattggtctattcagagattcagcttcttcctggtttagtcttgggagggtatatgtgtggaggtatttatccatttcttctagattttctagtttatttgcatagaggtgtttatagtattctctgatggtagtttgtatttctgtgggatccgtggtgatatgccctttatcacatctatttgattcttctctcttttcttcattagtcttgctagcagtctatcaattttgttgatcttttcaaaaaaccagctcctggattcattgatttttcaaagggttttttgtgtctctatctccctcatttctgctctgatcttagttatttcttgctttctgctagcttttgaatgtgtttgctcttgcctcgctagttcttttaattgtgatgttagggtgtcaattttagatctttcctgctttctcttgtgggcatttagtgctataagtttccctctacacactgctttaaatgtgtcccagagattctggtatgttgtgtctttgttctcattggtttcaaagaacatctttatttctgccttcatttcgttatgtacccagtagtcattcaggagcaggttgttcagttcccacgtagttgagcggttttgagtgagtttcttaatcctgagttctagtttgattgcactgtggtctgagagacagtttgttataatttctgttcttttacctctgctgaggagtgctttacttccaactatgtggtcaattttggaataggtttggtgtggtgctgagaagaatgtatattctgttgatttggggtggaaagttctgtagatgtctattatgtctgcttggagcagagctaaattcatttcctggatatccttgttaactttctgtctcgttgatctgtttaatgttgaccgtggggtgttgaagtctcccattattattgtgtgggagtctaagtctctttgtaggtctctaaggacttgctttatgaatctgggtgctcctgtactgggtgcatatatatttaggatagttagctcttcttgttgaattgatccctttacgattatgtaatggccttctttatctcttttgatctttgttggtttaaagtctgttttatcagagactaggattgcaacccctgccttttgttttccatttgctcggtagatctgtctccatccctttattttgagcctatgtgtgtctctgcacgtgagatgggtttcctgaatacagcacactgatgggtcttgacttttcatccaatttgccagtctgtgtcaattggagcatttagcccatttacatttaaggttaatattgttatgtgtgaatttgatcctgtcattatgatgttagctggctattttgctcattagttgatgcagtttcttccgaggatagatggtctttacaatttggcaagtttttgcagtggctggtaccagttgttcctttccatgtttagtgcatccttcaggagctcttgtagggcaggcctggtggtgacagaatctctcagcatttgcttgtctgtaaaggattttatttctccttcacttatgaagcttagtttggctggatatgaaattctgggttgaaaattcatttctttaggaatgttgaatatgggcccccactctcttctggcttgtagagtttctgctgagagatccactgttagtctgatgggcttccctttgtgggtaacccgacctttctctctggctgcccttaacattttttccttcatttcaactttggtgtatctgacaattatgtgtcttggagttgctcttctccaggagtatctatctttgtggtgttctctgtatttcctgaatttgaatgttggcctgccttgctaggttggggaagttctcctgggtaatatcctgaagagggttttccagcttggttccattctccccatcacttcaggtacaccaatcagatgtagatttggtcttttcacatagtcccctatttcttggaggctttgttcgtttctttttattcttttttctctaaacttctcttctcacttcatttcattcatttgatcttccatcattgataccctttcttccagttgatagaatcggctactgaagcttgtgcattcatcacgtagttctcttgccatggttttcagctccatcaggtcctttaaggacttctctgcattggttattctagttagccattcatctaatcttttttcaaggtttttaacttctttgcgatgggttcgaacttcctcctttagctcggagaagtttggtcatctgaagccttcttctctcaattcgtcaaagtcattctccgtccagctttgttctgttgctggtgaggagctgtgttcctttggaagaggagaggcgctctgatttttagaattttctgtttttctgttctgttttttccccatctttgtggtttatctacctttggtctttgatgatggtgacctacagatggggttttggtgtggatgtcctttctgtttgttagttttccttctaacagtcaggaccttcagctgcaggtctgttggagtttgttggaggtccactccagaccctgtttgcctgggtatcaccagcggagggtgtagatcagcgaatattgctgaacagcaaatattgctgtctgatcgtttttctggaggtttcgtctcagaggggtacctcgccatgtgacatgtcagtctgcccctactggggggtgcctcccagttaggctactcgggggtcagggacccacttgaggcagtctgtctgttctcagatctcaaactctgtgctgggagaaccactactctcttcaaagctgtcagacagggacatttaagtcttcagaggtttctgctgccttttgtttggctatgacctgcctccagagatggagtctacagaggcaggcaggcctccttgagctgcattgggctccacccagttcgagcttcctggctgctttgtttacctactcaagcctcagcagtggcaggcgccccacccccagcctcactgctgccttgcagttcgatctcagactgctgtgctagcaatgagcgaggctccgtgggcatgggaccctctgagccaggcgcaggatataatctcctggtgtgctgtttgctaagaccgttggaaaagcacagtattagggtgggagtgacccgattttccaggtgccatctgtcacagctttgcttggctgtgaaagggaattccctgaccccttgtgcttcctggatgaggcaatgccttgccctgctttggctcacgctcagtgcgctgcacccaccgtccgacaagcccctgtgagatgaacccggtacctcagttggaaatgcagaaatcacccgtcttctgcatcgttcacgctgggagctgtagactggagctgtgcctattcggccatcttggaactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcccatatccgcaagcacttaaaatgtcgttccaatcttcaaagaaattctttcattccatttttatctgcttttacccaggacattgtttcccagctccccagtagttcactaggtgatttgcatctcattagaagctccagaagtgacatctcccagactgctgcctggcattgtgggtccctaagcatcagatctaggtcttggattttccaagttgacacttttttaaaagctgagttaatgctgttttcccactgggtgcagtttgggtggccattttcgccataattcctgctcccgtgctggatcaaggttagggaactgccattgtcaaagatgaagtcagtcatctccacgtgaaagtacgtggtggatgagaatattctggggcctcagaataaaggagtttaaagactcctaaaaatagaaagatgctacatgatgcagatattctgaacactacacaaagcaaaacaaaaagacagcaagacaatagcaaaccattgctgaagctgtataattgattctaaacgtttgccttttaaacattttcccctggatccaatcctcctgagaccgcagagtttttgccctacatttatattttgctttaaagatagtctccctaggtcagaatgcctttttggctttgtcatttcttcatactacaacctccagaagagcactgaacagcactgtacctctggaaaccagagatagtatttccatggtcagcaaaattgttctcttggaataagagaaatgattttcccagtgtccagggaaataaggagcccttatgtctactttgggctcaagccatttgatgcagcttccagcacaaagcaagtgcctgatggtgcctagagcttccgccatccagaattccttttgtccagtgaatacttccctgagcttatgccaccttttcaaaatggcagatagctaatctgcagaattgatctaagctcttaggaaagggttaagtccatggtttttccaacactggctacaaattaaaatcactgggaaggaggaggaactttgttttaaacaagtaacaatgccagaaccctacccctgaccaattaaattaggatctccaggggtgaggtcatgatatctgtatttttaaaaagcccttcagatgattctaatatgcatccagggtggagaaccactccagtataacaagaaatacaacagccccttcgcagcacctgctaatgcctctggcaccatgttttatcttttcatatattatctgtcattctcactacaaccctacaaggaagggtcatcattcccaagtgaaggcctctaataagtgctgaggtggttatcatactccagtttttctgacttcagattcccaccccaacacacgtttctcaaagtgtgggacatgggccactagtggtcaccaagttgactcttgatgacgtatggatgtggcattaaataacataattcttttacataatttcttatgtaaaataaagttacttttttcaattctcaatttaaatcctccagattactttaaggagaaagtcttaatggtgctagtatgtcttaaattcctctcacatttactcatctctctttttaacaagccttttaagaaacccagaaccttctataggaaatggaatctagcacaagtgtgatgataccatttcactttcaccgtatttactatatagttcacttctatatatggcaaatgacactggttttccatttacagtggcgaataaagttccagttttaaagacatgtatttaagcaaaaaaaaaaatcagttgaattttaaaaatattaaatagtagtacaggtgaataaagtaaaaaatgcctaagaggtagatacgtgacaaaagtttgagaaatattcccctacaacatgctaatttttaaaacaggcatacccacacctgttagccaacgggactgctcatctaccatcctactccaatagactggcaacaacctgttccgtccactttacatccactcacgacctgtgaactttgctgctgtttccaactgaagaggaatcctgaaacacaaatggtgaataaactgggagggtagggaacattcagccttttcaaataatcaatggcatgcaaatagaaacacaaatgaggtgttatttttgcacctattaaattgtcagactttttcttaagaaccatctcatgctggtgaggacctgcttaaatgggtaatataggtataggtggcagaagtgtattttgctgcacaatttctggatggcgattgaaaaaaacaaatcataagtttttaaaatatgcatacctttggccagtaattcttcttttagaaatttatcctaaggaataaggaacatttgtcaaacaccaaactatgagtatgttcctcaaagcactgttattatagaaaaacattggaaacaacttctgtgaccaaaataggaaattatataaattaatcatgattcatccataaaatgaaataccatgcaagcattagaagtgataccatttaagctatctctggaagacagatatctctggaaacttgtctcagcagttactactattgtgggaatgagattgggtgtggaaaaaagacaaacttttcactgcttaacttatttgaacattaggttcatttattaccttttcaaaaagtaactctaaaagaaacatactattttaaaagttgcctaatagaatggaaatatttatgactttattgttaagtggggggggggggggaggggcggggagccataacccaaattaaatgaatgaatgaattttttagttaaaaaaaaaagaatacatattcctgtaaagatattgaaaggacagtaataaaaaatactaaggaactttgtttttagagactgatttcatctacctctttgaaacgcctctggacagtttccccagaggtatcccaggatacgaaagaccctcttcctattggaagcctggacaaaaacatcccaattaaccgtctgagaaccaaagaataggccacatagatggaagagatcttaataagaatggtgaatagtcagtattcactcattcactcattcattcattcattcttcattcattcgtcatttgttgagagtgtgccaggctctgagctattggtttcaggggaagttattgccacctccttaactaataagtagaaaattccacatagacaatttataactccagcatcttccacaggcactaatttagctcagggatgttttctttgtagcagttttgcaattttgaagaagattgttcatgacataacatggcaagtgggaaaatttgtagctttcctttcatcttaaaaagcaggatctgaattacatgcaccccaggagaaaatctctctttctggttgtgtgtgtatgtgttttacaaaagcccactgaattccttagttcctcctgaagttagacttggtgaagtgaaaacttatgaaaatgtctcagcaaaagtacaagcatcataatagaggccatgacctaggccctgggattttgaatcaagaatcttgagttatagcttagggacctaagctccttgagcctcagacctctcagatataaaagcaaggagccagaccacagagaattttcctccatgacatgacttaaatttggaaatctgagctaccagggcatacttccctgtctccaataacctgaggatctgttaggctctgagcattcctgaaatagtccatgcctcaaggcatattagggacaaggggattacaatacatttcttcatttttaaggtgatgtagattattggtagactttctgctgatatggttcttattgggaaggaaagatttaatatggtcaagcacaatggttcttaaccttgactacacagtagaaccacccaaagagatttgaaaaaaaaaaaaatccatgtccaggctttgacccgggcattagtattttaaaagttgaacaactggtatcatgttaaaaaatactctcagttggacttcaaaaacctgaattctcatttgggctttgcctctaactgtataatctcttagtctcactatgcctctgttatctctttagggttatttggccttgctaaaatgagatgaagtaaacaaaaagtactttgcaaaacaagagttgctatataaaaatgaaatggttaggggaagagacagagagccagaaaagacaggtcatgtcttcagaagctatttcatgggagtatccactggagtaccatgtgcatggtcaaccctcattgagaagaaagattgtctagctgacagctgggttattgtcacctgcaaatgccctgagaaccttggtcagaggagtgatgcacctttctttatgcacagagttggcagagctctgtaaattaattgcacaactctaatcctatttaaatgccccaggggtatagcttataacctcatataggatttgccatctgtaaatctagaacactgaacactctgtttgcttaaaggggatgtttcatttggcaaatgaacctgagaacgcctcatccacaaaatggcaatcagatcagcaatcacacagctcagaaagtatccgtacctgatgaaggaccacaggagggtgccagggtctatggctctcccaggatattctctccctttcttcccaggacccctgtgcgttgcctgcccattcctcaggagccaagaacgcattctgccccaccaagctggggaatacgtgggctgcatgctccatcctgcccttccttgcagttgtccttcacttccttcaagcttgctaggaaatttaccagaactggcacatctgtagcaggtgatgaaaatggaaacattaagttttagaggacagcgtaggagggggcatgtgtagccaaaatagctgcaactcagcaagtcaaatggagtagaagaagacattttcttcttcatctctgaaaccttggaagacgacaaaagcctcatttgtgacttacaactgtgcatgaattagggttgccagatttaacaaatagaaatgcagtacactcagctagatttgaatctcaaataaccaatcattttttaatatgtcttaaatatttcatggatgtaataaagaattattggttgtttatctgaaattcaaatctatctaactgtgtgtcttttttttttttcttttttgagatgaagtctcactcttgtcacccaggctggagtgcaatgatgcgatctcagcttactgcaaccttcacctcccaggttcaaatgattctcctgcttcagcctccccaatagctggaattacaggtgcacaccaccacacacagctaatttttgtattttaagtcaagacagggtttcaccttgttggccacgctggttttgaactcctgacctcaggccatcagcccacctcggcctcccaaagtgctgggattacaggcgtgagccactgctccgagctgagccaccgcacccagccatgtcctccatttcatctggcaactctagcttgagtatactggcatgttcaataaagagaaaagaaaaattaaatttacaaaccagttgtttgaatttatgtgacagattgactgaattcagctatttgtctctcaccaagggcttgggcacatgtgcagccacagtgtgacagtttgggattaggaagtaaggagtaggcatttgccagtgctcctgaaatgctatccagatttcttccattttctgacagatttagctccagtttattataaagttctataacaattcagaagagaaagatgtgttaaagttctcaaatatgaaatcagaaggtgcagggcagggggttggggggaggtgcaaagattcttgaaaaggaaagagacctatgttaaatgcaaactggtattcataacataatatacctttaaaagcccagtaaggaggtagttgccaatgtacgacaaagtggggagtttggtttgtctcatgggcatctatgcgaggtagaaataagccactttgagaatatgagcattatggtcctcaaagtaaaaactcacattctaatgtgaatattcaggccgggggcagtggctcacgcctgtaatcccaacactttaggaagccaaggcaggtggattgcttgaggtcaggagttcgagaccagcctggccaacatggtgaaaccccatctctactaaaaatacaaaaaattagccaggcacagtggtgggtgcctgtaatcccagctactcaagagactgagggaggagaatcgcttgaaccccggtggaggttgcagtgaactgagatcgtgccactgcactccagcctgggtgacagagcaaggctccgtctcaaaaaaaaaaaaaaaaaaaaaaagtgaatgttcaaacttgagttgcccagtttctctacataaactaatcaaacgaactaggtaactatccgataaccatactgttttatatcttaatgcaaactgactggcccaaaatccaaaagacagggttcaagttttcactctgccgcttacaaatttagccttttctggttatactttcttcatatatgcaaagaactaacaattttggtactatgtgccttattgattttttagtatttaaattttcaagggaaaaatcatgataaacttcttaatgcatgtacaagcatagatttagtcaatgtgctatatgttattttgtattttacttctttttccaagttttgaattttcttctgtcaacatcatacacatttatcgccgctttgtcagtgactcaagatatgaaacaatttttatatctgagttaatttcttctcgattattaaatatgtatcatgtttctagcttttttactgctataaaagtgttatggctgggcacggtggctcatgcctgtaatcccagcaattagggaggctgaggcaggtggatcacctgaggtcgggagttcgagaccagcctgaccaacatggagaaaccccatctctactaaaaatacaaaattagccgggcgtggcggcacatgcctgtaatcccagctactagggaggctgaggaaggagaatcgcttgaacctgggaggcggaggttgcggtgagccgagatcacgccatcgcactccagcctgggcaagaagagcgaaactctgtctcaaaaaaaaaaaaaaagtgttatgtctgtctgtcttcatacaaattgggttttttttcttttggtttacttcattgcaacgtattccttggaacaagttgcttagttctgggggtttttttctgggtttttttctttttttggagaccaagcgtcactctattacccaggctggagtacagaggcgcgatctcggctcactgcaacccctgcctcctgaactcaagggatcctcctttctcagcctccggagtagttgggaccataggtgcatgccaacatgcctggctaattttttgtattttttgtagagatggcacttcgccatgttgcctgggctgctctcgaactcctgagctcaagcaatctgcccgcctaggcctcccaaagtgttgggattacaggcgtgagccaccgtgcccagccagctctgtttattgccaagttgcacttcaggaggcagggaacctgtggattgtcctgtttctctggggcccctcccacattgtcttttaaccttatggtgtatgaattaatagagaagcagtaacaattgttaaattgaagctgttcgtcaggatagttcaacatttttcagtatctcgttttctaactatatttctctgtctctcgcctcagcctttccacattacggatgtaacttttatgggtatatatctttcaattgtttttatctttctgttgtacttcctttcatcttagttttgttactgtccatcatatggaacgttttactttaatataattaaacgcatgcatgtcactaacgtcttcttatacagctgagatactccatttctttctaaagttttttggagaatgtttaaaattctcaatatataactcatctcgaatttattgtggcctgtgagaatcaagaaatgtattgagaagagtaaaggatttagaattttaaaaactaaacaatttgagtccaacagcactagcttaaacggctttaaagaagtcacttaacatcttaaaacagtgtcctctactagattgaaaacagggactttgtcttatttctcttcgtattttccacaaaatccagcaaagtacactgtgtataggataaatgttaatatgtctgtatttaagttatatttttgcatattgccattaaattgttccagtagcatttattaaataatggtctacttcccaactatttattcggttgcttacaatggatcattgtatcagtgacactcagatttcttccaatggcaaagcacctggaagttacagcattctttgcagaacattgtgaaatatggaaaaattaaacttaaaataatgaaaattaaaatctgatgctaaatcagataactagcttataccagattctagtatagtgtagaaaccataagattagacaccaacagttgtttttaagtaatgggagaaatattaaaattaagaacattctatccaataacttaattccttataagaatcaggaaaaaaataaaagccaatgaaacagcaagttcgtcaagaacaaaagttgaaaatcatatcgtatataaagcattaccagttgagacaatataaataaaaacctctgataaaatgtaaacactatataaatatgaagtccagctgaactaggctgaactctagttgaacccaaaaacttcttaagatcagtcttttgagttaccatggacggaattcctgccgtattagaaagtctgagggagagtggatgtcagacctccagagcatacttcacaccagcagccggacctaaggacacttctcttcattgatctataaatcagaaaggagatgacacaaaagggactcacagcttcacattctaccatattgcagagtatggacttcacaaagcaaacaaggaggaggtatgttggaaccgtcagaaagaaccgctgtgttctttgtgttctgaggactttgccagcacaacaggctagattcctgtgctctgcacagtgatcatgaagaggtggatgaaaatgtctgttaaggctgttggaccttctgcaagcaacattgttttgctatgctaattaatatgttttcattgaggccagacatggtggctcatgcctgtaatctcagcactttgggaggctgagctgggcagatgacttgaggtcaggagttcgagaccaggctgggcaacatgatgaaaccccatctctattaaaaatacaaaaacttagctgggtgtagtggtatctgcctgtaatcttagctacctgggaggctaaggcaggagcatcgcttgaggcggaggctacagtgagctgagatcgtgccactgcactctagcctgggtgacagaatgagactctgtctcaaaaaatatgtatatatattatattctatataatatatattatattctatataatatatattatattctatataatatatattatattctatataatatgtaaaatatatattatattctatataatgtattatatatagaatataatatattctatgtattctataatctatataatacatattatatattatatagaatattataaataatatattctatattatatatagaatatattctatatgtttatattctatatattatatatgaaatagtatataaaatatatataatatatataaaatatgatatataatatatataaaataatatataatgtataatatataaaataatatataatgtataatatataaaataatatataatgtataatatataaaataatatataatgtatattatataaaataatatataatgtatattatatataaaataatatataatgtatattatatataaaataatatataatgtatataaaataatatataatatattatatataaaataatatataatatattatatataaaataatatatattatatataaaataatatataatatattatatataaaataatatatattatatataaaataatatataatatattatatataaaataatatatattatatataaaataatatatattatatataaaataatataatatatattatatataaaataatatataatatattatataaaaatataaatatattatataaaaatataaaatataaaatattacatataaaatatatataatatattacatataaaatatataatatataatacatatttttttcatcgaacttacttttacttaaacctttgactttaaaaaacatttcttcttaagaaaggcaatatcttataagctgggcacggtggctcatgcctgtaatcccagcactttaggaggccgaggagggcagatcacttgaggctaggagttcgagaccagcctggccaacatgatgaaaccccatctctacaaaaaatacaaaaatttgctgggtgtggtggtgcacacctgtaatcccagctacttgggaggctgaggcaggagaatagcttgaacctgggaggtagaaattgcagtgagccaagatcacaccactacactccagcctgggcaacagtgagactatctcaaaaaaaaaaaaaaaggaccatatgctatagtgtaaaaaaaaaaaaaaacaaaacacctattggaacaagaagtaagaaatctagggttgggtacccacctggccacttgatctgagatgagccattcaattttatgggcctcagtttctcttctgaaaaaaaaaatgggtatttagaatggatggatgtgatagtctttttttttttttttttttttttttttttgtgagacagagtctcactctgtcacccagactggagtgcagtggcgcaatcttggcttactgcaacctctgcctcccaggttcaagtgattctcctgcctcagcctctcaagcagctgggactacaggcgcccgccaccacgcccagctaatttttgtatttttagtagagatggggtttcaccatgttggccaggctgggttctgatagtcttgtccaaatatagatttgtcccaattcaagaaaaatcaagatacaaaactttatacttagggaacaaatattttggtattaataatggaccttgctaagtcactctctactttaaaaattcccccagaatttttttaaatcgtggaaatctctggtgaagttaaaatatgataccaagtaaaatctccaactctttttaatgaatagtttataataaacactctgtcctccaggatagtgatagcttttctctaaacaacaacattcatggacaatattctatgacagaggtgtgtgtgtctgtgtgtgtgttgccaagaaattagaactgctgaatcctgattcagatatagagccaaaaggacagtagatccaaaaaatcatttgcttggaagggaaatgaattatgactttttttttttttttttttttttttttttgagatggagtcttgccctgttgcccaggctggagtgcagtggcacgatcttggctcactgcaacttccacctcccgggttcaagctattctcctgtctcagcctcccgagtagctgggatcacaggtgtgcacctccacacccagctaatttttgtatttttagtagagacggggtttcaccatgttggctaggctggtctcgaactcctgacctcatgatccacccgcctcagcctcccactgcgcccagccatgaattatgacttcttctgactcgtggtttcttaatctccagggcactcttggtccagggttctgaaatcaggacaaacagggagagactgcttcatgtaatcgtgcaatcatcctttctccttctcttttacactacctccaaagactgcatgcatcagtggtattgttcaaagcatttcagtaaattttagctcaagccatttcccccccgacaaaatgtatcccaccaaaaggtttgcttctcacctccccaagagtatgtgtgctccagatgtttttgaactctcattgcaggatgtggtgcaaacaatcccagattactttggttgtcctaacatagtcatgccactaagggcaccctactctataaatgctgaccaccaacttatacttcaccaatgtggaaacaacaacttgctttctgtcaccctggactgctgattcagatcagaaagctgaatgcaaagttacagacagtggcccttgtttacacttagcaatctgtgtgtattttttaggatggcatttctcctaatattagtaaagcttttaatatgcccattaaaataggacacagtttctactaagtgcatttatgtgaagagccatttttcacttaattttcccaacacctcggacagtttacagcaaagttttgctcttttttcaggttcagaaaatggtcttgcacagaagcatcgaacacctcgccgacgatgtcagcagcccaaaatgctgagtagccctgaggacaccatgtactataaccagttaaatgtgagttcaaagtggccgtaaagctgtttcactggctttgtttccagttaataattctgttattactacctgttccagcccctgcagccccacccccaccctcatgctctcgtcttgaacatgtgcttaggctctttatctgttgctttcatgtcaggatgtctgccttcacggtgaataattgatgtggtttatcaaagacgagcaagatgcatgcttcatcaggctcacttgagccctttgatcaaaaaaaattatgctgtgacttctgatattatcagcatctgcttgcattcaacacaaaatcactttgaattaaaaattaacgacttgctgctttgctttgactgtgtgttcttggccctctccacagggaactctagaatatcaagggagcaagaggaagccaagaaaacttgggtaaatatctgtcttcttagttctaagcaactgtaaacagaaggggtcctttgtgatattacagaaaatgcaaaactttccagagaggcttctaaaaatatgcaatccagatattgccactcttattgacattggaaattacttttcacagtagcaagtatacaaaacttgaatctattctgtccaaaaaggttgaaattgtcacctaagggcaaatgttatttctcataattattccagggaattgtactttcttcataattagagacatgtagtgggttatataaaattctccttccacaaataagagcactctacgaagtacaaataggccacttcctccacattatcctacccctgggccttaaaaacatggacaaggagaaacatgcccaactggttagatagaggatagtaaggaatttgtcgttcatttgatagttagcatctcaattgagaacagcaatgaagtacataatggtaataattagagaattgggggaggtcaggaggaaaactttctcatctagagggaaccagatggagacagagttcaatcccataaagcaagttgcaatacgaccacaacttccagacaccacaaaactggacccactatcagtgcacgacccaaaggtgaagggctttgtagatcagaccctggtacctctgtactgggagaccctgagctacctaggagctgtccttcccctccagtgttggagcccaaccctgttccagctactcacatgactttagctgccccagtgatgattgtaacatttgttttattttttgttgaaaatcctgttgttttctttgttgcagccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaataatgataatacaaaaattagcccagcatggtggtgcatacctgtaatcccagctactcaggaggctgacgcaggagaatcacttgaacccgggaagcaaaggttgcagtcagctgagagcgcaccactgcactccagcctgggcgacagggcaagactctgtctcaaaaaaaaaaaaaaaaaaaaaaaaaagagatagtatgcaagaagacacctaaattttgagagaaataaccttgaagaaaatcttgttatcagagttttgaaagggagcacattaataggccttttatgaagataaataatgaaatgaggtatttaaagatctcagaaattgtaattttacaagtaaaataaatatagccaatttttcaatagctgaacttcacccaaaaggtaatgtttataagtagagcagaaaaaatgcagataaattttattttattgtttaaaaaataatgtgtagaatatataaattttttatgttactgttaatatacgagtgcttttggaagtttcacttttgtcactgattgtctacttttggtttgataatatgagctgcttttcaaattgttgaatggaaatgttcataactccctgcttgtccgtgcacaatgtaattctaaacctggcttgtttctcatttaaatatatctataaataaacttaaaaagaaaaca

SEQ ID NO: 938 - DNA, 477021 bp, Homo sapiens; identical to SEQ ID NO: 937

SEQ ID NO: 939 - DNA, 477021 bp, Homo sapiens; identical to SEQ ID NO: 937

SEQ ID NO: 940 - DNA, 477021 bp, Homo sapiens; identical to SEQ ID NO: 937

SEQ ID NO: 941 - DNA, 477021 bp, Homo sapiens; identical to SEQ ID NO: 937

SEQ ID NO: 942 - DNA, 11755 bp, Homo sapiens
ctcaagacttacaaactgtcctttattcagagtgagactgcggaacattaataatttatcacgcggggagtccccagaagccctgtgcccacgaacccctgtgggcggaggagagaggcggggactccgggagcttcctgagagggccgtgtcttgggagcaaggtgacatattcagttcaggcacgcggaacatgaactcaggaagtggggagacagagagacccatcccccaactcccaggacgggggccaggccccctaaaaaggcacaatggcagggcaggtttggcagagtggttgagtgtcaggggtcgacaaaggacaccatgatgtagcgtgtgccccaggtcgttggcagcccctcgtggtagtgggtgaggcggccggggtgcaggagtgcccagcccttcctcggggaggagatcacacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtcactcaggctggagtgcagtggtgcgatcttggctcgatcttggctcactgcaacctctgcctcccggtttcaagcaattctcatgcctcagcctcccgagtagctgggattataggcacctgccaccacacccggctaatttttgtatttttagtagagacgaggtttcaccatcttggccaggctggtcttgaactcctgacctcaggtgatccacccacctcagcctcgcaaagtgctgggattacatgtgtgagccaccacgcccggccatcgcagggtgtcttcagggagatgacggtccctgtccagggaggggaggggaggggcggcgggacccctgcgtaggaggctctcgctgctcactggcattaaattagggccaagcctcaccttgggtctcagcctggcgccctccctcccctggggtgcctcctgcagcgtctcattcccctgggaactaaaatgcatggagcccaaatgctgccggggccgaaaggggtctgcgtggagacttcctgtccgggactggggtggggaaggtggggaggcagctggcaggtgggcagcgcaccttggtgtggtaaccgggaaacaggctctcggtcatggggcccacatacgtccgcagcagctgcagccactggtcctcgtaccccacctgcttcatgtggatgtccacggtgggcacattctcgtagcctccagccagccttgaatcctgggggcggcgggcactgagccacccgcccctccagccatggcgctccccaccccagggcagtccagcctccttcctcccgtcctccagccttcacacctgtgttcctctgtgcagaacagtcttctttgctacttctcggcctgactcactgctcccggcccttcaagtctcagctaagatgtcacctgtcctgtgaagctccctactcctcccaagtctgggtcaaggcttccccgtggcttctattgcacccaggctgctcatcgcagccttagaagctgtgtggtggctgctgctcacagcagggcagagctcgaccggcatgaggcattcctgcagtgcagtctaggacagtggcccaggaatgatttccttttctctttttttagagacagagtcttgctctgtcacccaggctggagtactgcggcatgatcatagctcactgcagcctctaactctggggctcaagtgatccttctgcctcagcctcctgaatagctgggacatgccaccatgcccggctaatttgttggtttttctgagatggagtttcactcttgttgcccagcctggagttcaatcttggctcactgcaacctctgcctcccgggttcaagcaattctacctcagctcccgagtagctgggactacaggcgcccgccaccatgcccggctaattttgtgtttttagtagagatggggtttctccatgttggtcaggctggtctcgaactcctgaccccaggtgatccacctgcctcggcctcccaaagtgctgggattacaggcgtgagccaccgcacctggcccaaactcggctaatttttaaattttttgtagagacagggtctcgctatgttgcccaggctggcctcaaactccccctgctcgagcaatcctcccgcctcagcctcccaaagtgctaggattacaggcatgagccactgtgcccagcagtaaatatttcttgaatacatgaatgaatgcagttgtgaccccagggtctgcctcccccctgggaacccctctttgctcccattttcctgattccattgtttgtttaccagatcctgcacctcctcctctgggaaggcctctgccctcctcgcccaggcccttacctcatgccggccgcctgaccactggccgtagtgctccatctctgccaccagctcatcacacatttgttctgacagcagtgggaaccagtacacgtccgggcatggctgaggatggggcgagggagaacagggctagctgacgccgcagaacggggaaggggacaggcagcaggcagaatgggaaggggcagggaggagcagggaaggctttgtgagagcagccggggacccgccaggtaggggctgagggagtggcaaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctcccgcctcagactcccaagtagctggaactacaggcacatgccaccatgccaagctaattttttcttttcttttttttttgagacagggtctcgctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcctgacctcaggtgatctgcctgcctcggcctctcaatgtactgggattacaagcatgagcaccactcctggcctcatttcttatttaatttttttgttgttgttgtagagacagattctcgctatgttgcccaggctggtcttggacttctggcctcaaccgatccacccaccttggcctcccaaagtgctgggattacaggcatgagccactgagcccagccccattcttcttttaagatgtgatttcaagcataacaccagtatacccaatatacaggagaagaggctgtctgatcaatgctggctttgggggcaagagtcctttctgttcggcctctgccttcatcttgtctgaacagaaaaccctcagatctctggggaactcagtgtgaaaactttgaatccaggcgggggcccccaagaggcgatggccatgagggcagggggtgggtggggaggctgcgtgggctcacctgctccacgattccttccccttccagggcccggctgtagttctcgtggatgtactgctccttccagtcctgtgagagggtggggggcacatcagatctgtgcccccctcgctcccagcccccaggggaccgccccctcccactcagtgtcctgcgctggcagcagccatcacgtttggtgtcttccttagcacaaggcggggaacctgtgtgctctgggcgtggggtccccactcacgacggggttgtcgaagatctgccagaggtcggggtgcaggtgctccgtgtcgtatctggaagtggccaggagccggccaaattcatgctgattgctcagatggaggaagatgccctgtagtggggtgggggtgtccgtgatgcaggcgatgcctggagtctgggggactgcccccaggccagaccgtgcacccgcgctcaccttgtctcgaaagctcttacagaaggccatgtccgggtctgtgtcactgcccgagaacacatccctctggggcagctccatccgcagggtatcaccccggatcacataggcctgggagatgtatggtacattccacacacccctggaggcaccgacaccgcggtcagctgggaggacagccccccaaattctgcccagctcatcccgggaagtccttcttccctcagggtatcccagtccctgaacataaggcccctgcatgtcccttgtcaagcactgctggtcccaaccaccccacctcccaaaatgcggtcagttcctaccccaagctgtggcacttcttttttgtttcttgtttttggtttttgagacggagtcttgctctgtcacccaggctggaatgcagtggtgtgatcttggctcactgcaacctccacctcccaggttcaagcaattctcccaccttagcctcccaaatagctgggattagaggtgccagccaccatgcccggctgatttttgtatttttggtagagatggggtttcaccatgttggccaggctggtctcgaactcctgacctcgagtaatccacctgcctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacgcaccaccgtgcccagctaatattttaagttttttgtagagataggctcttgctacgttgctcaggctgatcttaaactcccaggctcaagcagtcctcctacctcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcggagcgggcgtagtactcatcggggctcagggcgccccagaagttggaccacagcttgccgtggcgggacagcatgggggcgatcaccttcctgcggacaggtgggggtgagggctgggcagacgggagcaggcctggggagcccggtgcccagggcaggagtggggttcccggggcctgttggggtgccctccggctgcggggagagggggtaagccacctgttctcctcaatgaggatacgcagggtctgcaggttggtgaggacagcgtcggcgtccaggctgaagtagaactcacactcggggtcctgccgacacaggtccctggaggtgagaggcgagctgagacggcggcaggtggggaggcggtgtggatggggtaactggcccatgcccccaggagaagaggagggaggcagtgtctatccttccttccccaggctctctgctgtctgggtgagctggcaagggcaggagtgacagcatgggggctgcaaggatgcgaatggggaggcccaggaggggctggatgggtgacaggtgaggcaagggccaggcagcaggtggcagcacccctgaccctacagcctcatcccaccctctcctccccgcaagcacccgctcacatggccatgtccctggcctcgcctgggctcagagcctcctccggccccacgagcttcacagctgagaagtggtcctggagctgcggccaggagtcagcgatgtggggttcatggaagacctcctgggaggggaagacatagggggatgggctcagagggcagggaggcggcacctgagggatgggggtgcaggaaggagatgggggtgggggcacgagagttctgatcagggcagggaaagggtccctcaggagaggctccaacaggggagtctcacgttgttgtgcaggaaaagggtgaccctgtcggggggatagtccaggagtagcagccgctgcaggaagcggggcagaaacggagtaggctgttccacaaacacggccagaaacacccgggggggaggctggaagatgcaacacgcagggactcagagagaagcccggacttccctgctgcccccacccaacctccaccctgacaggtgcagggacccaggagcgatgcccccaccgccccccagtccgctgtccttgtacctcctgctcagcacgctgccctctcgtgcccctccctggcacccccacctcacctgcccccccgggagtgtcctccggtcctggttgcagaagccacagcctccctcaggagtccagccattggggacgtagtttcccaggtagttgagctgcagctgttggggacagactgaggctgagtggctgaggcctccaggggtggaggtgggggtcaggcacctctgatatgggggctgggaagggccagcttctcagaagggttggaggtgcctgggggttggggcagggcggggcgggggttgagaccactggtggcaccttagtgggaccgtttccatggaccacaatggggagcgtgtcgtaggccacgttccggatacgcacacggttccgatcaaactttaaaaccacttcatctggggaagaaaaaggccaggcttcagaccccctttctctgggagctaccaagcaacacattcttctaaatatggggtcccaaattctccagggaataaagggacaccagggctatcctggagtgtggctcgttgtgggcaggaacctttgggttctgaccaggctgctggcccagagagctccactgcctactacctgcgtgatcacaccgcagctgggcgaggaaggggagggtgagctgagcgggaggccagtaggagcctcagcatccctacccctcctcatattctctctctccttgtttttttttttttttatttttattttttgagatggagtctcactctgtcacccaggctggagtgcaatggcgtggtctcggctcactgcaacctctgcctcctgagttcaaaagattctcttgcctcagcctttcaggtagctgagactatgggcacatgccactacacctggctaatttttgtatttgtattttttgttttttatgctgagatggagtctcactcccaacacgcaggctggagtgcagtggcacgatcttggctcattgcaacttccacctccagggttcaagcgattctccttcctcagcctcccgggtagccaggattacaggcgcgcaccaccatgcccggctaatttttgtgtttttagtagagacagggtttcaccatgtcgaccaggctggccttgaactcctgacctcaggtgatccacctgcctcggcctcccaaagtgctaggattacaagcatgagccaccacacccagcctaatttttgtatatttagtagagactgggtttcactatgtcagccaggctggtctcaaacttctgacttcatgatctgcccgcctcagccttccaaagtgctgggattacagatgtgagctgtcgcacctggccttttttttttttgagaaggaatctcactctgtcacccaggcaggagtgcagtggcgcaatctcggctcactgcaagctctgcctcccgggttccagtgattctcctgcctcagccttctgaatagctgggattacaggcacccgccaccacgcccagctcatttttgtacttttttttagtagagacgggttttcgccatgttggccaggctggtctcaaactcctgacctcaagtgatcctcctgcctgggcctcccaaaatgttgggattacaggcgtgaggcaccgtgcctggcctctctctctccccgttctccccatcccctgaggcaagtcaccaacccctccacaagctgttttcctcatctgtacaagaaggataaccagggaccttccctttgttaaatggaatcacagaagtagaccgggcacagtggctcatgcctgtaatcccagcactttgggaggttgaggcaggcggatcacctgaggttgggagttcgagactagcctggccaccatggtgaaaccctgtctctactaaaaatacaaaatgagctgggcgtggtggcgcatgcctgtaatcccagctactcgggaggctgaggcagaagaatcacttgaacccgggaggtggaggctgcagtgagccaagattggaccactgcactccggcccgggcaacagagcgaaactctgtctcaaaaaaaaaagtccctggcccggtgcccaggcacagcatgtgtgcaacagatgccagacacgtttttgcttcccttgcttctggtagtaccatcagcacagtgcaacttacacaaccagccactcagacgcctgacaaaaccacatagaggtgggcttggatcagcccagctcctccagaagcctctcccagctcaagacccctagctgcagaggctgcgcatcgcccacctgcggctgtcttcctcctcacctaaagccccgttgaggttctgaaagatccgagacttatgatccagattaaggctgagtttctcctaaatggaatgagatgcgatggagtggttaaaatggaaggagtggaaaggacatcatttctcacttttctctctctttttttcttctcttgcttttgttgcttaggctggagtgcaatggcacgatctcagctcactgcaacctctgcctcccggtttaattgattctcttgcttcagccttccaagtaactgggactacaggagagtgtcaccacgcctggctaatttttgtatttttagtagagacggggtttcaccatgttggccaggctggtctcaaactcccaatctcaggtgatccacccgcctcagcctcccaaagtgctgggattataggcatgagccaccatggttttcctttttttgtgagagacagagtctcattctgtcacccaggctggaatgcagtggtgcaaaacatcctcaaactcctgggctcaagtgatggtcccacctcagcctcccaagtagctgggattacaggcgtacaccatgaagcctggctaattttttctttctttttttttgtagagatgaggtctcaactatgttgtccaggctggtcttaaattcctggactcaagcaatcctcctgcctaagcctcccaaaagtcttggatgacaggcgtgagccaccacgcccaggcacacatttttctctttgcaaccccctttgctccccaaatcccattcagcctgaggcctccactcccacagagctgcgggatgcgcccactcctctgccttccctaccctcagtcctgggtccaggtagagccgtgtgtagaacagctggtcgtcgtcatcatccttgtacttccactggcgcacgatttggtggatggtggtggcaaaaccgatgaatcctggcggggagggggagtgttgacctcgagactcccagggtcccagggcctgtcccccaggctgtctccagccctcaggcgcctttaacactctgtgtcccaccgctcttggcccctctgccttgggcactctgccactcaccaccagaattgaggaagcgcttccccgtgcccacctcagggtactgctccgccagcccccactcgggccagcagaagctctctgcagagaagagcaggcggctgccactctggacgaacttcttcagcagctctgtggggctgccggccagaatcacgtcgtagctgggtgaggaaggggaggatgggcaggggtccactgggaacctcagcatccttaccccgctccctatccccagccccgttacctatccacaaacatgatgatcatatcctcccggtcagcgtatttctccatttccttctttaaccaccggaccttctgtcctccaccaactgttcgagccacatcaccccctcgccactcctctcccaggcccagggtctgtggagaagattgccccgtgccaggcaaggggtggggagttgtggggggaactcctgaccaggcttaccgtggggacctgggcatccagacttcagcccacccctcctgctgggaccccctcccaggggcctttccctctcctcacccgcacagtgtagttgaagaactccgcagagcgcaggaaacgcaggtacccctcggtttcagctgtggccacagtgatcaccagcagcttctctgttaccagagggaaatggcacttgagatccaccgcccagctccgggcctcacgtgctttgctgtcctccctctcactcgacttccctccctttcttccttcccattcttaaactcttctcacccaggaacactctgaccccaaggagggcagggtgggagtggtgcccaggaattccgagtccctttgcatagggaggctggaaaccccagttcagggtagtgatgggcgaggggcttggcgcgactcagcctcaagagcacgctgggcgggggacgggccagacacctcctcgagcctccgaccctctccgggccaggctggcaggcacgccagcctctgccccctcggccgtgccgggcctccccgggatctcacctgggttgaccgggtctcggccccggggccggtcggaggctgaggccgcagggggcagcagcagcggcagcagcagcaggaaccggggtccaggccccgaggaggtcatggtggggagcgggcccagacagcacccaggatcctgggatctccgctacgcgcctggatcccagctccggaggggagctctggaaagggggcgctcgggctgctgtgcggccgccgcggggagcagcttggctggggctacgccctgaaaaaaaggcgtatccggaggctacagaaagctccagatgccggcgccacagacaaggcgaggattgtcccgggcgcacgggaggcgggggaggggcggcggctcgggccggcgggcgggagacagggactctgggctgagccagccgcttgacacatgtggaagctgaaacctggacaggggaagtgacccctggcggagggtcgggcgggacgcgggggcgggtcctggccgcagccctgcccagagagtgcgggcggaagacggggagagcgagaggctggcggcgacagggagggaggaagccta

SEQ ID NO: 943 - DNA, 5291 bp, Homo sapiens
tttgtagaaatgaagtctcactgtgttgcccaggctggtcttcaactcctgggctcaaacgatcctcccaccttggcctcccaaagtgctgggattacaggcatgaggcactgcgctgggcccagaactaccttttattggaggcatggagtccacagtgggtggaggtctcagtgccttgggctcaggggctcagcgaaaggccgcggccaggcctagatgaaggtgaggcaggtggaagcggggaccccacagctttccttgtgctcctcgaagagctgctccagggccgtcatgtagagggcgtgatagtgattgacttcctcctcggtggggtggaggcgctgggggacggggatggggcggcccactgcagggagagggagacaggtgggcgagggatccctgatgcccacgcagctgctggtggccgtccccccggaggtgggcactcacccacagtggtgatgggcacagcaaagggcagcaggccccaggaggtggctgagaagagaccgcgaccccagaagatgcaaggagagaagcccatgagcttcttgaaggtgagctggcaccaatgctgccaggagcctgtggcaaaagccttaagtctaaagatgtcattctccccaaaggagtacacgggcaccagggacgccctgggaaggagcaagagagaagagggggctcaggctgctggactgctccgagatgggcacccccaggggctacaagtccttcccactacgtccagatgctacctcccagggtcattcaaagcacatgactatggctacaaagaaagatctagaagacaggactcgcatttctttctctttctttttctttgttttagagagagggtcttgtaaccacacctgtaatcccagcattttgggaggccacggtgggaggatcatttgaggtcaggagttggagaccagcctggccaacatggtgaaacccccgtctctgcaaaaacataaaaattagccaggtgtggaagtgggtacctgtaattccagctactacagaggctgaggcacaagaatcgcttgaacctgggaggcagaggttgcagtgagctaagatcacaccactgcacttcagtctgggtgacagagtgagactttgtctcaaaaaataaataggctgggtgcggtggctcatgcctgtaatcccaataccttggaaggctgaggtgggtggatcacctgaggtcaggagttcgagaccaccctgaccaatatggtgaaaccccatctctactaaaaatacaaaaattagccagacgtggtgacgtgcacctgtagtcccaggtacttcagaggcttgaactcgggaggtggaggttgcagcgagccgagatcacaccactgcactccagcctgggtgacagagcaagactccatctccaaaaattaaaaattagaaaattttaaaaaataaataatttaaaaaattttaaaagagacaaggccttgctctcttgcccaggctggagggcagtggtgcaatcatagctcactgcagcctcaaccttctccgctcaagccatcctcccacctcagcctcccgaatagctgaaacttcgggcgtgcactaccacacttggctaatttattttattttatttttgtagagatgatgtctccctatgttgcccaggctggtcttgaactcctggcttcaagtgatcttcctgccttggcctcccaaagcactgggattgcaagtgtgaaccaccacgcccagccgggactcacatttcttgagacacagttgtgtagtgggccttctcatagtcattttctcattcggtctttgcaataacaacatcgtggcaaggtaggtatcagccctcttcgcaagtaaagaaacaagtccggccgggcacggtggctcacgcctataatcccagcactttggaaggccaaggtgggcggatcacttgaggccaggaattcgagaccagcctggccaaaatggtgaaaccccgtctctactaaaaatacaaaaattagcccggagtggtggtgggcgcctgtagtcccaactactcgggaggcggaggttgcagtgagccgagaccacgcctttgcactccagcctgggcgacagagcgagactctgtctcaacaacaataacaaaaaaagaaacaagtgcaaggtcttgcctttgagttggggtcagagagggaagccagggcttctgagaccgagggccctgctatttgcattatggtcctgtctccacggatgtgggagggagcttagggtaagcgggccccatgtttggtaccgagtcatgccctggagagcccacgtgggcctcggtgcagggcagggcgctggtctctgggcacccggatcccccatgcagggacctagatgtctggggactgagagagggcataaaccagcagagaactgacaggtagggcctgcacgcgcactcacccgtgcctcagcgccaggcgcacgaagcctttgcgcttctggagcgtaaggcagtgctccccggggactgaatacagggcctcgtgcgcaccccccaccatgatgaccacggcctgcccgagctggggctgggacaggatgaagtccaggctctggcggctcaccggacagagtcctgtgggcaggaggaggtggaaagtagttcccatctgcctccacggcacccccgcccctcacccagcctttagttccaagccccctacccccatctccaaggcggggaacctacccaaatgctcactgcaagtctgggcagtgctcaggctggcccctgtcctgggtgggggacttattatgggggggggtggtcccagaggggctggggaacatctggtcaggagtctcctcccgttctcctcctcccattcggctcaccaaaggacatgatgtagtcgcgatagaccgggaggtagaagaggccagccagcacggctaaccagggccggagccccgggaagagctgggagaagccattgctctcggtggagaaattacagaggaagcctgtacacatgatcccatgagggtgggcgcccagcacgtagttccgatccgggggcagctctgctgttttcaccagcttcggggtgttgagcaggatgaagggaggatggaaggcaagacaccggctgaaaagaggggccctccaccccaacagagttccgagttaaaggttcttaggatagggtcaagggccaccccagcagagttccgagttaaaggttcttaggatagggttaagggcccaggttttttttttttttttttttgagatggagtcttgctctgtagcccaggctgaagtgcagtggcacgatctcggctcactgcaacctccgcctcttggtcccggttcaagctatcctcctgcctcagcctcccgagtagctgggattacaggcatgcgaaactatgcccagctaatttttgtatttttagtagagacgcagtttcaccatattggccaggttggtcttgaactcctgacctcgtgatctgcctgccttggcctcccacagtgctgggattacaggcgtaagccacctcacccactctctctttttttcttttctttttttgaggcagagttttgctcctgttgcctaggctggagtgcaatggcatcatctcagctcaccacaacctccgcctccctggttcaagcaattctcctgcctcagcctccagagtagctgggattacaggcatgtgccaccatgtccggctaatttgtttggtatttttagtagagatggggtttctccatgttggtcaggctggtctcgaactcctgaccttaggtgatccacccacctcagcctcccaaagtgctgggattaaaggcttgagccaccacaaccgcctttttttttttttttttttagagacggtctcactctgttgctcaggctggagtacagtggcgcaatcatggctcactacagcctccaactcctgggctcaagcaatcctcccacctcggcctcccaaagtgcttggattacaggcatgagccatggtgccccaccaaggccccgctcttgaacatcatccactcccaggccgggcgcggtggctcaaggctgtaatcccagcactttgggaggccgaggtggctggatcacttgaggccaggagtttgagaccagcctggccaacatgttgaaaccctgtctctactaaactacaaaaattagccaggcatggtggcgggcacctataatcccagctactagggaggctgaggcatgagaatagcttgaacctaggaggcggaggttgcaatgagctgagattgcaccactgcactccagcctcggtgacaggagactcagtctaaaaaaaaaaaaaaatccattccctgtcccactgcctgagcttaggcagcggggagctcaggccccagcacaaggaagggctcctaggtgtgggagggagatggggagaggtaggaagcagtttttctgcagggtgacccatcaccttgacaggataataatcccttagttgtctccaaattgcccggttccttatccactccgaacgccttccacctgcggacaatgagatactggtggacgaacccccggagtcacctcccctcaccccccatgtccccaccatctctggctacctgggcccccatccggagctcaccttggttgggtgtgtcccagtccacatagagccacaccaagtaaaaaacagagaagggccagagtgacgtgaagaggaggacaaagacaagaagggagaagaaagggcctgggggaagggagagaaagaaaagagttcacttctgaaactccatcattccctccagctgctcccttcccttcctccccttcagaacaaccagctctctcctctggccctctcccagaccagtcacctggtcactgtcctcaggcatgcaagccagcagcccagccactctccctccaagccctactcccctggcagaccccaggcacccacgcctccccagctctcacccatgaagaggaaagtgagcacatattggtaggcgcccactgcttctagatgctgcttctgcaaggttttggaagtggttgggggctgcagggttgtggcaactcccattgcagaagctcccctcttccagcaggatcccagaacccggaggacaaacgatgaaggcttggatgtggacctgggcagactttctccctacaggagcccagctttgggggcctggctaagtcgcaaatcacctcccagagtagcgtgtgtccgtaggtgtgtgagtg

SEQ ID NO: 944 - DNA, 6488 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaaggggggcagaaacgcagacctaacactgtattttactgtgatttgtgatttgtgctatggcagagggaagcacagcgcctgggaacagggagacgtggcatctagcccaggttctgggaggcaggggactgtgaaagcttgaaggaaaaatgaaaaagcttgaattgagtcttgaaagtctagttagggtttctctcagtgggaacctcacgtgcaaaggcagtgaagcaagaaaaagcaagtcgcttaggaagccaagttcacagtttggatcttacagagtaataagaaaggatcgaaggctggggaaaggttacattttgaaaggcattatacacactgcccaggagtttgaactctgtagggaaacactggagagccagcaaagactttttttttttagacagagtcttgctctgtcacccaggctggaatgcagtggttctatataactcactgcagcctcaacctcccatgctcaagtgattcttccacctcagccacctgagtaggtggaactacaggtgggtgcaggccaccatgctgggctagtttttatattttttgttgagatgggtgtctcactatgttgcccaggctggtcttgaactcctgagctcatgtgatcctcctgcctcggccttccaaaatgctaggattacaagtatgagccactgcgcttggcccttttagtttttctttctttctttttttttctttttgagacggagtcttgctctgtcccccaggctggagtgcagtggcgcaatctcggttcactgcaagctctgcctcccgggttcacaccattctctggcctcagcttctggagtagctgggactacaggcgcccgccaccacacccagcttatcttttgtatttttagtagagacagggtttcaccatgttagccaggatggtcttgatctcctgacctcgtgatccacccgcctcggccccccaaaatgctagaattacaggcatgagccactgcgcttggccctctcagtttttcaaaggcatcgcagtctcccagccatcagttttttcatgttggcctcaaggtctgaaataccccgctgtctcccctagccaggtcattcaccagttaggccttaacctagacttaccttcttctgggaagtcttccctgactactccaaggccaggttgggtgtttctgtcctgggctctgcagcactttatacttccgtatcctagcctactccatgctgtacttactgtgtttgtttcattaatcatttgtgtttgccactggactgtaagctttggcatccctaaaacctagagcactgcctggcatttggaggggagacagagtagtacagtgatcataatcatatttttttttgtttggttggttttgggtttttttttttttttttttttttttgaaacagggtcttgctctgtcacccaggctggagtgcagtggcacaaacacagctcactgcagccttgagctcctgggctcaagcaatccttgcgcctcagcctcctgaatagctgggactacaggtgtgtcccactacacctggctaatttttgtattttttttgtagaaacatggttttgccatgttgcccaggctggcctcgaactcccgcgctcaaacaatccacccaccttggcctcccaaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccagggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggtgaggcggatggaggaggaagcgggggatgggactgagaggagggcgggagagtccgcccaactcaggctgtgggaggacccaggagctcctggtgcctctgccagtgactggctcccatggctgtgagcaaccacaccccctttctgtgcctcagtttcctctcgtgtatgtgaaataaacaagagagactggataagctctgacacgaagccttaggcttgggggcatggaggtgactgtcagctgggattggagaattggggtggagggcagaggctggtagcgaggggccgacttagagccaggagggcagggccaggtgtggtggctcacgcctgtaatcccagcatttgggaggctgaggtgggcggatcacttgaggtcaggagttcaagaccagcctggccaacatggtgaaaccccatctctactaaaaatacaaaaacaaaattagccaggcatggtggtggacacctgtaatcccagctactcaggaggccaaggcaagaaaatcacttgaacccaggagatggaggttgcagtgagtcaagatcgcaccactgcactccagcctgggtgacagagtgagactgtctcaaaaagaaccaggagggcacatgggcatggggagtgatgaaccagagaaagctgctgtctttctgggcaagtgccaagcaacggatcacccttgacccctaggaaagaaaaagaagaaaacccgaggtgatcattttaaacttcgcttccgaaaaaactttcaggccctgttggaggagcaggtgagaggagggtcggcctgggaggaccccacagggaaggggtgagcctggcccgggcaggtgttcgctgcgtgggtgggcggaggagttctagagccggccccttgtctctgcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgagcatgagacctgctgtccactcccactccctccttcccacagcctccccagacctctctcccctcatcctggcttcccctctgtctgcaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 945 - DNA, 41609 bp, Homo sapiens
gcacatcataatcaaacttcttacaaccagtgacagaaaaccttaaaagcagccaggaaaaaaatgacatcttacacatggaagagcagagataacagtaatcttgctggaaatcacaggtagataccacttaacatccactaggttggcaaatttttaagtctgaacttaagtgttggagatgctatgaaacaaaggtaactcacagtgccaagagaggtataaactagtacagtcacttcagaacacaaatttggcattattttatcaatatatcaagcaatataactgctagatacaatgttcacagcagcattgtttcaacagcaaaaacaaataaacaaaactcaaatgtccatcaagaatgaataagttgtagtatatttatataatactatatagcaataaaaatgaaagaaagtcacagaagtaaacattttgccatttatataaaattcagaaacatacaaaattaacatttcacttacagatacatacgtatgttgtaaaactataatagacaaatgacaaacacaaaattccaaataattatttgagagggagagggccttagggaacttctaaaatgtcgacaacatctgtatcttaagctggctgatgagtacacagatatttacatttattatccctttatatatacgtttatgtatttttgtagtatgaaatacttcattaaaaaaagagtgaaaatgtaagacttcaaaaatgaagactaccatttatgtataacaataaaattagtgtaaaaaagtatacaaagaaaatgttcaattctttatctttccgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcgagatcggctacgacttcggttctgagttcggtctctcttttcactcttttgtttctcccaacagctttcttcttcttcatagtgaccaaaccccatttctctatagatatcctgtcaaaggaagggggaattacaagtgaatcagtaaaataatcattttgtgggcattttcaattaataaaacttagaaaagtctaccattagaaggctgttataacagcttaaatgtgaacactaccactaatgtcaagaatcttgtaaattacaaagcaataaaataattcagaaaaaggtttaacaacgtcattgatttgtatctactattttggctgaaacgaaggatcagcttcaaaaatatggaactgaaatagctcaactgaaatcagaacatgtctctagagcaatctgcaaaatcaaaaattctgattatgtatagtcttattcccagctccccacccttcactcccccaaaacgtggtcccattattgatctgcaatgaaactactaaaattcccataagaatcctataagaagatatcattgaaataacttagcaggaagagatcttagacaagtcagtaagtcttaaataagaaaatggaggctggatgcggtggctcacgtctgtaatcccagcactttgggaggttgaggtggatggatcacctgaggtcaggagttcaagaccagcctgaccaacatggagaaactctactaaaaatacaaaattagccaggtgtggggacgcatgcctgtaatcccagctactcgggaggctgaggcaggagaattgcttgaacctgggaggcagaggttgcggtgagccaagattgccccactgcactccagcctgggcaacaagagcgaaactccatctcgaaaaaagaaaatggataatgtatacttgggtctgagcaattaatttttaaagtgttttattttataacagctcctctctagatgttcaaatacatcttccatgtttagaaagacagaagttagagaggagaattttttttgagacaaggtcttgctgtctcccaggcaggaatgcagtggcacgatcatggctcactgtagcttcaacctcccaggctcaaccgatccttcccacctcagtctcctaagtagctgagaccacaggcatgtgccatcacacctggctaatttttgtatttttttgtagagacggggtttccccatgttgcccagggtggtctcaaactcctgggttcaagtgatcccctcccacctcggcctcccaaagtactgggattacaggcatgagccacctcactcagctgattaggcttatgtcaaaattattatatttctttaaaatgagtttttaaacactggtagaatcctttgccccaaagataataaaattgctacatttaattctactcttagaccacagccaatgctctttcaagagatactttgtaaaatttaactttcttaagactgcccaaaggaaaggaaaattctaaggactaaactcccaagggtctcaactctatcaccagataccactgtagcagacataaatgtcaaggcttaaaattcagagtgatgaatacccatggttaaggactgggttttaagcaaattattagttattccatatactgtctagatactgtacaccttgagtttgacagtgtgtgaaaacagatgtaacaggattgttatagtaataatcacactgtgtaatacagtattataaactgatttgtgattttccacacaatcccaatagttcttgtcatattataagagtccctgaggtagaaaaaatgagtaggcattttggtttagccttttgccatcaattttctagtaaaatatgacattctgagataaaagaatttttgtgcttcctataacatatacaaaatagaaatattcatatactattatatctgtacatcttgtacttatttctgtattggttgagacaaacttttaaaatgccgagactgctggctgatgtataaatttataaaatcctcagtatgttattatacaaatgggcacttaagtgctttgagtatttaaaatagaagagataaaagattatgtagcacttcattcttttaaaaatttgaggaagctgaatatttgaattggactgaaactttaaaatcactcctactcgggagtagttttcaaagctacacaagctttgaagtcaggtagatctgggttcaaatagtctttgacatttaggagatgtgtcaaacaagtactcttaaggttagaataattagagaaggtttcatggagaagttaggatttcagatgagcctcaaagggtaagtgagcttgggtctgaatgggctgcaagaaggctaatgaaagtagtgtaagtgaaaactgaaaagcaaggaaaaatgagccctgtatgtatgaaggggaaaagttaaagtggctgaatgaagccatgtaagaggagatcctccaagtacatgctaacacagtgctaagagctttaggagtgcaatatcctcattctagaaatagggaaactgagactcaagagatctgcacaggttggagataatttaacttgacatccaaaattaaaaaggggggagtggtacagaataatggggaaaaaatccaacacctgactgaaccaaataaatgttaaaattctagctctcccactataaaggcctaagggcctgtgggatcagtatcttcatatctaaagtgagataaatgaattagataaggtctaggtcctttccagtatgaatttttaaaagttatattatttatacatttaaaacataagacaagatgattaaactaccatgtggcaaaaaaagaaaagaaaaaacgaagaacacaaaatggccaatttaaagcaattaacctagcaaatgacttgaaataagcaatcaaaaaaagtctaatctaattaaaagctatccttgctcaagtctctgggactaaatcaaagatctggttaaatcttagtcaccaagataacattaaatcactaaaatgacagaaaaagtacagtcaagaatacaaacactatgaaaaccccagtggaaaactgacaaccagcatgaatacttctcagcaaggcaacccccagctgaatacgcatttcctgtaaccccagtaaaacccaaacctcaacaacacaaaaaccatctctggaattaagacatgaggtggaaaattaaacaaacgttttcgaattgattagtaaggctagttactcaataaaaaacaaagaatttgaagaaataagttaaaatactcttgggaaaccagactcactaagcaaaacaccgacaaacaggaaaatatgaactatagctgaaatttgtctagtactgaaaattctctttaatgaattttaaaaaataaaaaacaaaataataaaaaatcggggggccattaaaatcttaaatactgatgctgagttttattaggaagaagagaaaattaatgtagctatatcattaaatcaaagtacaaaactttttaaaatttaatatactttaaggggagaagttaggagatcattattcagaatttaataattttatagttaatattgccttaaaatttcaacttaaaattgccttaaaatctttttaaaaatactaatagcattcccccaaaatcttgatgcttttactccatgcaaaatgagaaggatatttgctactgtaaggtttcaagtaatcaaacagcagaatcagaaagactcacacaaaaaaaacacaaccagtctgaaattttttagacctctgattatctcaaacacaccaatgtttatttatctcaggcttaaattcatggacggttccatgtacaagtgcaggatgaaaagctggagctaaaagcagcacatggagggggaaagaattcagagtttttagtggaaaacatgctaaacattcacaggaatgtgatacagccaccagtaaagaagactgatgcgacctcagactaaagtaatagagtacagacatttaagaaggaggagatgtgttcctattagatcacattggaatattatactatgggacaaattttattaaaataacattagagtttaggaaagaaaactgatgagaatataccccaggtaagaagacgagcaaaagtagttaggagtatgtttcaagttaagagtagttagtttcaactatgaaactaaactgtggttccactacttactagctgtgtaaaactatgggcaagtaacaatttttgttctcactttgttgtgtgaaagggggataaaagaacccaccttacattgtaaggaccaaaaaatattaactactactacttttttcttttatttaaaatttttatagagacagggcctcctatgttgcccaggctggtcttgaactctgggatcaagcgattctcctgcctcagcttcccaacatgctgggattacaagcatgagccactgcacctggcctactactacttttattaccaccgattcatgtgagaaatatttgcaggaaccaacaaaagtatggcctgaaaacgggatgaggcatgaatgatggcaatctttaaacagctaaagggctatagaaagaagaaattctatctctgctggattatagcaaagagctaactacatatatcaaatatttacttgctaaatttttttaaatcaataacccataaaacacataaaatagttacccacagagggaagaaggaaaaggggagggaacaagaatggaagctaggttctctaaatgtaccattttgtagatttcactttggaaacagtttttaaaactacaaaacaaaaaattgttaaagcaacccttaaaacattaaaaataaataaataaaaatgaaacagggccgggcgcggtggctcacgcctataatcccagcactttgggaggctgaggcaggcagatcacgaggtcaggagttcgagaccagcctggccaacttggtgaaactccatctctagtaaaaatacaaaaatcagccaggcatgatggcaggtgcctgtaatcccacctactcgggaggctgaggcaggagaatcgcttgaacccaggaggcggaggttgcagtgagccgagattgcaccattgcactccagcctgggcaacaagagcaaaactccgtctcaaaaaaaagaaagaaaagaaacactttaactgaaatatgaatctagttaatgtcataaccacagagagaaactattccaagtaactctaaaactagtaatttgctttaacagttaaaaaaaaaaagtagtaacaataataaccagtgtagaaaatgtttgcacacgcatttttttcactgaatcttaacaaaatgcctgtgaagtatttctcacttttcacagaggatgaaactgtggctcagaaagttaaacaacttgtcaaggtcactttgatggccagcagtatgtaaacctagctctcctgacagcaaatccttgactctgcctatcatactacatttctctatttctgcatctttggttaacattctcaccatcttaaattccctcccttctcacctcagcccactgaaatccttctcatccaccagggcccagcataaatgtttctatgtggtaaaacaaaagcaaggagctctgatgtaaaaaaaaaaaaaaaattttttttggagacgtggtctggctctgtcatccaggctggagggcagtggcatgatctgggctcactgcagcctctacctcctgggctcaagcgatcctctcaagctcccaagtagctgagaccataggtgcacaccaccatgcctggccaattgtgtgtgtgtgtgtgtgtgtgtactttttgtcaaggtgtgtgtgtgtgtattttttgtcgagatgggggtttcaccatgttgcccaggctggtctccaactcttaagctcaagcgatctacctgcctcggcctcccaaagtgctaggattacaggcgtgagccaccgtacccagcctgtaaattgctttttatttaactaagaaccaaagcacaggctggaaataatcacttttcttcacaataaattttctttggggaatttttattattttttttaaatgtgctgttcaggagagcttttagcatgctaaagttaattaccagtgctgtttttcttatatacaatacagcaggatataaatgttttataggatgtaaaatctcaagagcccttaagtgctatacataacacttggtgataaattaagcagataaatgacaaaatctttttcagcacaaccacacttgtttctgatgggaataaaggagtatccacaggtacggaaatcactcttgcttcacaatgtggaagtatttgatacattaagttatgtcaaaaatgatcttttatcatttgtgataaatatttttgaaaattaaaatcccataccccagtgcaaccattctgcttcttaggaacaaacccatctctgcttagaactatcccttacctcctaaattatatcactaagacatcatttacagagggataaaatatttatttctccacatctaagtctggacattagaggtacctgattagtatttttgattggcatgtagtcctcatcttctttctcttcagaacagtgatgggttttcttcttgtgttttttacttgtgtgtgagtgacttgattttgagtcttcggcctgctcatctaatataagatcgtattttgtactgcagtagttagttaaggataaatgtgataaataatactggtaagacatcaaaacttaagatctggtaaacaaaggaggtcataaggctaaaagtaactaaagcaaaaagcatctcaaaagaatatagtacatttctaaaacaaaactaacattttctttcattatatagtcaggagaaatggaaagaatcctaatcctaaacaatcttaaaataaagactagtaggcaaaaaaattaggaggaaaaaataaacgtatttgtcaataatttaaaaaatttaaatttagaaaatgagggacatctttaactagaaaaaattattataaattccaatgcccagaaaagctatataagataacaggtacatttgtatgtctcttcttttagttcaatcaagaggaaattcagcaatgcatatcgagttatcatgtttaaattcttcttattattttttttgagacggagtcttgccctgttgcccgagctggagtgcagtggcgcgatctcagctcactgcaacctccgcctctcaggttcaagcaattctcctgcctcagcctcccgagtagctgggactacaggcacatgccaccacgcctgactaattttttgtgtctttagtagaaacggggcttccccatgttggccaggctggtctcaaacacctgacctcgtgatccacccgcctcggcctcccaaagtgctgggattacaggtgtgagccaccacacctgcccatcatgtttaaattctaataagaatttatgaatacagttaaatgaacaaaaatatacataaaagccaggcgtggtggctcacacctgtaatcccagcactttgggaagccaaggcgggcgactcactcgaggccaggagttcgagaccagcctggccaatatggtgaaaccccatctctactaaaaatacaaaaattagccgggcatggtggcgcaacctataaccccagctactcgggaggctgaggcaggaaaatcatttgaacccaggaggtagagacttttgtgagccgaggttgcactactgcactccagcctgggtgacagagcggggactcagtctcaaaaaaaaaaaaaaaaaaaaaaaaaaaatatatatatatatatatatatatatacatataaaaaatatgcataatagtattacttttagtagcaaagtaggaacaacaaaatatctagtaataaagacatacttaaatgcattatagtacttcaacaagatacaatattataaatgaagttatcaacaacgataaatgctacagaaaaaaccctagaaaggtgtttatgaaaattaacatgaaaaaagcttaaagcaaaaacaacatataccatacaacgattataactttacataagagaaaggtttgaaagaaacaaggagaaataaaaagtatcatgtgtctaggtgatgaagctacgagtgaatctttttaaatttcatctaaatgtgttaaaaatgttttaatgttttaattcagagataagtattttcttaaatatactataatagaataagagaaaatataaaagagttacgatttctgctgaaaataatctcaacctcaaaggtggattttgaggaagactgacatgggctggaatggtggttttccagagaaaggttatgaggaagcccaacaggcagagctatgctaattacatgtgggaccacagtaaacgcagacacacttccctcaggactagaggctcgtgtctgcttcacaaagccacaactcaacactttccacaggaatgtctcacttctacataagatcaaatgaaagacattgttcctcctagcttcccatgagatggctaaagagggttagtcagctcgtaccattcggttatgactccattatctccaacttccctcttttcactatgctactctgtttccggggcatcttctggatcttgccttttccagatacacattccatagctcccacctatgatttcatcctaatgtgtgctctgcacatgctgctccctctgtccaaattcttcagagcactcagtcttgctctgttgcccaggctggagtgcagtggcctgatcttggctccctgcaaccaccccatccagggttcaagcaattctcctgcctcagcctcccaagtagctgtgattacaagtgcacaccaccacacccagctaattttcgtatttttagtcgagacagggtttcgccacgttggccaggctggtctcaaactcctgacctcaaatgatccacctgcctcagtctcccaaagtgctgggattacaggcatgagccactgcgcctggctcagagcaatgtttttcaaactgatgactataatccatcaatggggtataaaatctatttagtgggccacaacagcatttaaaaaaaaaaacagaaatacagtatatgcctaaaaaaattttattttattaatcttttggttcaagtgtgtgtgtgtgtgtgtgtgtgtgaatgtttgtactgtgactgtattgggttaagacaaaaactgtattttttttaattttttttttgagacggagtttcactcttgttgcccaggctggagtacaatggcgcgatcttggctcaccacaacctctgcctcctgggttcaagcaattctcctgcctcagcctcccgagtagctgggattacaggcatccgccaccacgcctggctaattttttgtatttttagtagagacggagtttctgcatgttggccaggctggtcttgaactcccgacctcgggtgatctgcccgcctcggcctcccagagtgctgggattataggcatgagccactgcacccagccaattttttttttttttttaagaaaaaaaaaatggagaccgggtctcgctatattgccctggctgctctcaaacttctgggctccagcaatcctcccacctcggcctcccacactgctgggattacaggcatgagccactgcacccagcctatttcttaaatgatggatcatacgaaagaagacagcactcccatgagccactgcacccagcctatttcttaaatgatggatcatacgaaagaagacagcactccacctcagccctcctatctcccatattagtgtcacagctttaatgccacttttttcagtgttgagggtattctctaacctctcgccccctattatgagtcccatatctctttgcaatatttatttgcaataatttagacgtatttagaatggtaattatttaatgtctggttttttttccccactccaacagcaaaatgtaagctctatgtgggcaggaactgaatatctttcattgctaaactgagtatgtgacagatgcttactaagtatctgttgattacttgtcataccctcaagacacttgttgtatctcctgcttcctcacttacccactatcttgtacttatcactaaaatcaacactttcagaagacatcaaatccctctccctttgaataaaacacaaatttgtgagctcactgccatcttttctccaatttcttccctgaggtctagttgggccaagttatttccttctcctacttctatttttgattcttcttattaataatctatactttcactaatttctctttctcttaaggcccataaagtagatgccaccatgccttcttaactgacttaagacaatttatctgcacatcagactatcccctaacagcatttctctcttttgcatcaacttcaaaaggctagaagctacactattccatataagtatatgtgtggttgtttcaattaattaaaattaaagaaaacttaaaattccccttcttccagctatagttattagtaataagcctaaatttaatttcaaagatttggtaaataaatatcaaatgtattccattcataacttttatgattttgagctttcaatcatatgcccttgaatgttgatcttttctgaccaaatctcagcttcttatttggtctgtctgcatgtgaaagcctctccttatgctgattttatcagctttcttcagactttatccagttctaacacctcacaatgctttatacattgcagacaatcaacacatcttaaaacatgaatatagaccaggtcaacctgatattcatctttcttgatgagtacttggaaaagaaatgtctacatatgtagaaaaaaaaatccctgaaataccaatagaaactaggaaacaaagacaccatttaccagaaagaatcacaacagaaataactcttgcaatgtgtggagtgatatatttataatgggaaaaattagtgaaccaatttaaatgtcataatataaacagtatgtttcattactttttacatgtctcaacctaaaacttggaagaacctgaagtaaatggtcaagtcaatggatttctttttaatcctacaaaagtgaactcttgcactcagtagaagcccaataaatatttgttgttgaaattacaatatactataccgaaagaagtaacctaacattgtaacagagaacaataggattttgttatctaggtaaggaagttaaacataacagcaggtagcacaaaggaatcagcttagcaataataaatttcagattatgaggaatagaaaacattacaattacatatagaaaatacaaagctagtgttacagctcttttagaatttgtctagtaggctttccggtttttgcaggaaagcccccccaaaaagaaaatacaaatcttacctgaagatcttctgagaatatgataagtaggaaagtacttaacctagagtaggaaagtattaataaaagaattaggctacagatttctttcaaccttaactttctccatacactagagtatagtgaaaaagcaaagtatatgtaagatcttgaaaagagataatgataaactaagttacttcctcacaaacaatctggattcaggaaatttgtcttctatagcttttgtgacttttcataacacatcacacagtactctacacatagcagatggtcaatacatattaactaactgattcttggtaaggatactcctgtttgggctttactttatctttcagaaccaaattaggtggtttatcctgttctttttcatactccttgaaatcactcttggtgtatttcccacctatttattaagaaaagaaaaaaagagcttagtaaaaaaaccacctaaccaagaacaataattattttataaaaagcataagagctattttataaatggcatatatcgagagacagagaaagggaacaaaagaatcatagtaattccatctccattactaatttgaaatcagacatccatttttgctaggtagccacatgctgccacctaacgatatatgtgaatattacaacatcaaactttcaaataaattacacacaaatgccgtgttcaagtagagccattgagcccatgagaacattaagtccagtggaaaactgaggatttgggacctgagtttaagatctgaaagacctaagtttgagagaagtgagactttaagagaccttttaaagatctaacgagatagtgtgtgcctgtaatcccatctactcgggaggctgaggcaggaggatcgcgtgaacctgggaggcagaggttgcagtgagccgagatcgtgccactgcactccagcctgagcgacagtgcgaaactccgtttcaaaaaaaaaagatttaacaagagatactctgctaaatggcaacagagcatcaggcaaatagaagagggcaggatgtgcagaagatcaccaaacagctgtgagaggagagggtgggtaatagcaccaaagacaaactgtctctactttgaaattctaacttaggggcaacttcattcctcccaagtgccaaaaatcccctcaggaaaataggacctactgctacatcctaactagcttggtagggctagaaaggaagagcattcaatgcagcctctctactctcaactctagtctcctatcagatgagaattcaattttcaagtctcctaccagatgagaattcaattcgcatccatgtcccagacctgttgactgccctgcctttcctatccctcaaccacaccactaggaaatgctgtttgtagaaaggcttcctacagaagggtcctagattaaatgtagaagtaaaacaaactggaggtacagacagaggttttgactgagaatcctatgtgtaccttgattgtcagggttttaaagggggacccatagggtaagcaaaaaagacaagatcaatctatttggcaattccagagactccagaaacaaaagtggccagcaatgtttcccataaatgtgaaacagtctactgcaagagttaaaataactggtaatggtaacaaacagccatcatttatcattgaaaaattatttgccatctgcctgccattaaaagtctcactatggatgaagcagttaccgtataacagaaagggcaccagattaatgtaagaggttcttgactgtagtgggaggtcctaggtaagacaccacttctctgcaattcattatctttatttacattatcttcatttataaactgaaaataataccaacatttcacagagttgctggaatcatcagactataaaggaaagttcttagtgctgtgaatggcacattatacacattaagtttataaatgtgaatcaataacatatataattatctcaaaattaactgagaataataaactgtatgtttatgatggcatatacaaaaccaaagcttctccctcctatgtgacattttatcttaggaaaaaacatgaagaaatttatttaaaagtcacaagaaagtagtagtatttattcaatgggtggatgggttgagaagaagacaggattgagagggtaaaaaacaaaccaaatgtagggtctgtctaaatcatctgtgtatgtgactctaggtaaatcacttctcaagattatgcctcaaattccatatctataatgaggaattataatatttatttcatacacttcccaaatgatacaattaaactagctctttggaagcagagctctacataagagccacctggcattactactggccagaactacactgcatcaggccagcagctcaccaacactttgaatatacttactggaatctttcattcacaaagttgtaattttcatatgtggaaaaaaatcttagtgcttcaatttaggtttcacaaatcactcaaacagcactgtcaaaaactagccatgtgttctaggaggaggtaaggtttcacaggagaaactaatagtacatggaactccaatccaagtcaccctctcctttatcacagagatcacagcttccactcaacattccttgcctactttagtcacattaataatttcttccttctctgaactcccataaggtaacagaatccaccaaacaattcagcaattcacaactaaatagtgtttttctttcttactaaaaacagacaaaaaaaacagttcattaaaagcatgggaaataagtgttatagaaaaagaaagtaaccctgaaattcccagtaaaatttagcattacatgtgagtaactatcaaagtgaaacctgttaaaaacactgcatcaaaaaccaaaaactcgtattatttcaacatatgagagacccaacttttaagactgacatgctacgagcaatgtatttgacatatatgtatgtgtatgtgggaaatgtaatatgtacaaaggtggaacatactgctatggacatggaagagtaaaaatttagaaaacccattaacagggctggttcattttatatactgatatgaactgatctcttagatacactgttaattaaaaaatgcaaggtacaaaaacagtatgtatagcctgcatcctttgttttatattttcctttttaaaaggagaaaatcatatatatatatatgcacatatgtattcaaaaaatgtaggggaaagttagtaccaataggtgataatggttaccctggaagagaaattagatagatgaggagcaggaatgaatgagacttttatctacctttccatggaccttttctattttgcatcatatgacaactaaaacaaacaaaaaaaatttaagttgtgcacctaaaagactcaaaacaccataaagtcaaaataattactttggaaacatatcatgtctgcagtgggtaattattagtaatttataatatagtcaaacatagaaaatataatttttcatcagtttaaaatacacgcacaggtgcacacatgcatgtgtgtgcacacacacacacacacacactctacctcagattctagatagcaggtttgtaaaattacaaatggcaggagttacatcaattaatatttctcctaattaacagcactcaataaaaggctcatacaagcatgaaaagcataacaaaaacaaggccgggcgcagtggctcacgcctgtaatcccagcactttgagaggccaaggcggtggattacctgaggtcaggagttcgagaccagcctggccaacgtggtgaaaccccatctctactaaaaatacaaaaattagctgggcatggtggcacatgcttgtaatcccagctgcttgggaggctgaggcatgagaatggcttgaacctgggagacacaggttgcagtgaaccaagatcgtgccactgcactccagcctgggcaacagagcgagactccatctcaaaaaaaaaaaaaaagcagaacaaaaacaaaagataaaccatcataccttttcctttccatttaacctttgcaaccgactggctaaaatccacatgtattcttctgtcatctataagcacattgtccattttgaagaatgctttctcacaatcttcttcctgataataattataaaaactcaagcataaatctttatggaaaagatttctgtagctagaatactgaaaatacaaaaagtttgttgttacaaaaattaatgtttgaatacttattacacacccgatgctgttaaatgctttgtatctattacctcaaatacctctggtaacaaccccatgaggtactatccattttcttaatgagaaaacagaagtttagagaagtatagaagttgttggcaagggtcagagccaggattttagagagacagtccaactgcagtgaacagataaatatacacttactgactgtattatacaggttcacaatcctttttactcaaaattcaaaaacatcctggaaagtgaaagttgtgttcctaagtttgttgttaaaattaatttggcagtaacaccaaacctaatggtaggttatgacctttttttatccacttagtatgaatattcatttgtttcactgcagaaatacttttgtgacagattatggaatgctgacccagaaaggtattacataatcacagatgtaatgtgtatgtgtgtatgcatatatacagtattacctttctgaattctgaaaaattctgaattaggaagcctagttattctcaagggttttagataatgaactgtgagactgtaataccaagctctgtgctacacaagaatccttcctgtcagtaacttcacaattctaaatccctgtttctgacactgacagttacatatttcaactcagtactgaccaattttcttttacattcctggaaacttattcttactagagataatccaaagagaagcagataaaatagttataatcatatttattacatgtcaataattaaatgaattataaaatccatgaagatatagacaaagcttgattcgtctttgtaactacatcatttagaacatcatatggcatggtatctaaaacgtaggcaatcagtgtacgtttcatgaatctgactgattattttcaggcaggtataattctatcaccatgctatatccccaaagagaaagctctgaagatcactttttcaggaggatagtatttgcaaatactcaatttacttacacctaaataatagttaataaatctcttcaaaattgagaaactgattcaaaaataaatattcaaaagtcaaaaacagctatgacaatcttcaaaaacaacaaagttggaagactcacagttatcaagacatttataaacctatagtgattaacacaatgtaacagtggtatatgaatagacaaatagatcagtgcaacagtatagcgtctagaaacagactctatacatatatggataccgatttataacaaaagtggtactacagagctgtggggcaggacaactttttttattatttttttcatcagtagagacctcagagaaaaaggacaactttttatttatgtattatttttttgagacggagtcttgctctgtcgccaggttggagtgcagtggtgcgatgctggctcactgcaacctctgcctcccgagttcaagcaattctcctgcctcagtctcccgagtagttgggactacaggcacgcaccaccatgcccagctaatttttgtatttttactagagacggggtttcaccatgttggccaggatggtctcgatctcttgacctcgtgatccacccacctcggcctcccaaagtgctgggattacaggcgtgagccaccacgcctggccaggacaaccttttaaataaatggtgctgtcacgtggcaatccaatgtatgaaaaacgaaacaatgtaatacaatacaccaaaagcaaattacagaattgaatgggaaacaatttcacaacaaagcttctaaaaataatacaggagaatatcctcatgtctttgaagtaggaaaatattttttaaataggccactaaaaaggaagaaaaatactgacaacctgaaccattaaaattagaaatttgtttataaaaagacaccattaagaaaggaaaaaggcatgcctgtggtcccagttatgcaggagctaaaattggagaatcacttgagcccatgagctcaagtccagcctgggcaacacagagtgatcctgtcccttaaaaaacaaaaaaaaagtaaaaggaaatccacagagaagatatctgtatcacacataatcaaaaaagagcttgcatccagaaaatataaagaatccttagagatcaataaaaaagtaaaacagcaggtgcagtggctcaagcctataattccagcactttgggaggccaaggcaggtggatcacttaaggtcaagagttcaagaccagcctggccaacatcataaaaccctgtatctactaaaaattcaaaaatgagccaggtgtggtggcaagcacctgtaatcccagctacttgggatgctgaggcatgagaatcgcttgaaactgggaggcggaggttgcagtgagctgagatcatgcgactacactccagcctgggtgacaaagcaaaactctgtttcaaaaaaataaaaagaaaaaaaaaaaagaagaaaatggcatagctgcaaaaaactcaaaacatgggcagtcattagtctatgtgctacaaatgaaattttatttgtgagaaaataaataatagattctatagtgtcaatgatagaatgctagtgcaggtctacaagttttcacagcaaaccaaaggtaaaggtctttctgctggcaccaatgtaccttgtaagtatcatttctggtacatctgacacagtgcctacatataactttatggtctatcttccccaaccctccatgattcatcttgtatccctaggccttattgctgtgtctgaaaacataaaaggtattccataaatgctttgtaataattagaacttagaatgagctactactggatacatatgagtccaaagttgcattaaaaaagagcataccatagcacagtgtaaactcaatgggaacagaatcagacatatctgagttcaaatcccagctatgacattcattcactaggtgtgtgattttgaacaagtcacattagcattatgtgtctcagttaacttatttggaaaaggggatggtccctatcttacagaactgtgaggattaaatgcagcaaaagtaacataatgcctagcttaaagtaaatatttaagcaacataagctatcattattacagctctagaaggggccatctattctaatacccaagttttatttataagaaggtaagacctagaaagaacggttaactaaactgccaagtatcatacaatagctggctaataacaaaagatgtattaatatctaaatcttaacacccagttcagttctctttctattactcaactttatctccacttaagtaacagggaaaaattaagagtctctgaagggctttacttagaacttaaaaagttctaagattggctgagtgttgtggcttatgcctataatcccagcactttgggaggccgaggcaggtggattgcttgaggtcaggagttcaagaccagcctggccaatatggtgaaaccctgtctctactaaaaatacaaaaaaattagcagggcatggtggtgggcacctgtaatcccagctactggggaggctgaggcaagagaatcgcttgaaccaggaggcggaggctgcagtgagtcgagactgcgccactgcactccagcctgggcaacagagtgagaccctgtctcaaaaaaaaaaaaagttctaaagatactttcatgcagattgcacctgaacctaaagtaaaagtacgtatgttaacatcaacagatgttgaacttatcccctatatagatacaataaacttaattttggggagtgccaaaagaaagggcaactctagaaactagaaaaagttctataatttttcacattttaataccatataaaagcaaataaataccaaacttatgtctgtattatgacataccttttcaaattcaataaaagcgtaacagagggactctcctgtcttccagtctcggataacttcacaactgaaagaaagtatttaaaagtgacttaaaaaaaaaaaaaaggaagaaagcattcactctcactcttcaaaactgaagaagaaataagtcagttactacaaggcaaagttaaattcatagattatttttccaaattcatttaataacaattcttttttaaaagtagttcaccagagcagtaactaaattatctaaattctactctaagtgccttatataggcctacagtcctaaattcccttaagcactgaagtaagaataaaaatatttaattttcctttggcaaaagtaaactactgctaaagacttttaaaatcacaacacttttctagtccaaatatagtcgaattatagaatatctaacatctaacattactgtagaataatgtatgcatactcatacatatataaatgtttaagttcaagctttgaaatttttgaattttaatataaatcaagctcaaatttaacactgtaagcacaatgttaattacagaactaatataccataataaccaagtgaaaaggccaataagctgaagttgaaagcacctggcttgtcccttgccccaagtgtcataagtctcattttaaaaacctcattttaaaagccgggcgcagtggctcatacctataaccccagccctttgggaggccaagacggacggatcacaaggtcaggagctcgagaccagcttggccaatatggtgaaaccccgtctctactaaaaatacaaaaattagctgggcgtgttggcgcatgcctgtagtcccagctactcaggaggctgaggcagaagaatcacttgaacccgggaggcagaggttgcagtgagccgagatcacatcactgcactccagcctgggcaacagagcgagactccatgtcaaaaaaataaacaaaaataaataaaataaaataaaatccctgaaacaaaaggaaaccctaaatataatactttttaatcaattacaaaatagtccccttcctcacagaaatactagcttcatagactttttcattaatgcagggaaaactaaccaaaagaaaaattttagaaaatttagttttaaattaattttgacataaattgctggtaattccaggagttgaatgagataaatattttaaatattaaagaaggctgttgagagtattacagaactagatttaaattgttccattcatttcctgttttagggtgaaaatgtgttgagagtgggagattcaattatttatctgtgtgtgtgtgtgcacgtatgtatgtatgtctacacacacatatatacttttcttccctactgtccaaagactcacctgtaaaaattcaccagtacaaaattcgcctagaattcacagaatcatcaaaatatgtcattagaaaaccaccaactgatacctagtttttctaaatatctctttcactaattctaaggattaccttcttattggcccaaatctagagaatattatttccagatcctcatctgtggtcactgggttcaatttacacacaaacagtacattttctggaggtttaatatctgcatcaggtaggtctcccacctaaattacaaacaaacaaaaacataaatcaattcctatttagtttccattctaaatcctatccaatcccacaatgctgatttccttaaaacatctaaatttatgttacaaactgcaggctctggaaaagaaatccaaataagatttcaaaatttgaactacactgttcctattcttaacagtgttaatagctaatatttaaataactcatactttgtgtgaacagtgcttggagcttcagatctattacgctaattcttgaaacaatcctgcaatctccattttaaagacaagtaaagcggctgagcatggtagctcatgcctgtaatcccagcactttgggaggccaaggggggcagatacttgaggtcaggagttcaagatcagcctggccaacatggtgaaaccccatttctactaaaaatacaaaaattaaacgggcatggtggtgtgcacctgtagtcctaactactcgggacactgaggcagtagaatcgcttgaacccaggaggcggaggttgcagtgagctacgccacttcaccccagcctgggcgacagagcaagactccatctcataaataaacaaataaaataaagacaagtaaagtgaaatttaaaaggttaaacaagtaacttgcccaagaccacacagtggtaaacaacagagctgggatttgaacctacatttatctggcttcaaagaccaattttacccctacttcatcttttttcaagtatttgatatattttttaaaggataagaatttatgtaaagtacatgtaagtcataaagcataaaaataaaaaccactatgatgctaccatctagcttaagaactaaaatgtcacctatcccattctccctgtgcctcctcatcagagacaacaaataccctgctttttggttttcctttttcagtcatttccttgcatatcatcagagttttaccatatatgtatgcaactctatcacatttagatggggcaacaacatccctttatacatacattcaaacactctttcagagattatttctgataagatcacctgtaaagtgtctcctcttggataaacatgcccttccccccaaaatcttgaaaataaaaaacagtaagaagcaacacagccagtaagatctcctcagtgtttctgaagtctatcaaaagacaacattatgtccaataagaagtatcacagccaggcatgatagctcacacctgtaatcccaacactttgggaggctgaggaaggaggatctcttgaagccaggagtttgagaccagcccacgcaacatagtaagaccttgtctctatagtaaatttaaaaattagccaggcatggcagtgtgagtagtcctagctattcagaaggttggatggactgcttgggttccagagtttttgaggcagcagtgagctatgatcacaccactgcactccagcctagaaaacagagtaagaccctgcctctaaaaaacaaaaaagagtgtcaaaacacagaaggagtagagcaaattagtaaaaatcctccaaagcacctataatggcagaaaggaagcacaaacgagaaaaaaagttaatgagtcaaaaaagaacttgctatagtacttggtcaaagctaactttaaaatactattaggaaatttaaaacattcataaaagctatgaggttcaaaactaattttacaaaacactagctgaattatcactatattacaaacaaatgcaataaagtaagagaaacagatattcttagaaaacagaacatggaatatgttaataaaatcaaaaggacacaggatcaccttttagagtgactaaaatccaaaaaataccatcagcaaatgctggcaaggatgtgaggcaaaagaaaccctcattcattgctggtaggaatgtaaaatgtaaagccactttagaagacagtttggcagtttcttacaaagctaaaccattcaatccagcatctgaactcctaggtatttacccaaatgcatagaaactttatgcctacacaaaaatctgcatgcaaatgtttacagcagctttaatcacaactgccaaaacttggaagcaaccaaggtatctttcaacaggtaaaaaatatacaagctgtgatacatccatacaatgaaacattacttagcaattaaaagaaatgagctatcagccatgcatggtggctcacgcctgtaatcccaacactttgggaggccaagacaggaagatcacttgaacctgggagtttgggatcagcctgagcaacatgggtaagactccatctctacaaaaaaatttaaaaattaccaaggtgtggtggcgtgtgcctatagtcccagctactcaagaggctgaggcaggaagactgctcaacctcagttcaaggttatagtgagctatgacagcaccactgcactccagcctgagtgaaagagtgagactttctctaaaaaaaaaaaacaaaaaaaagaaagaaatgaaatcccaggccgggcaacatagtgagactctgtctctacaaaaaataaaattagccgggcatggtggcacacgcctgtggtcccagctacttgtgaggctgaggtaggaggattacttgagccctggaggtcggggtgcagtgagccattattgtgccactgtccatgcaacagagcgagaacctgtctcaaataaaaaaaaattaaaaaaaattaaaaaaagggccgggcagggtgactcatgctgtaatcccagcactttgggaggctgaggcgcgcagatcacgaggtcaagagatcaagaccatcctggctaacacggtgaaacctcgtctctactaaaaatacaaaataattagccgggcgcggtggcacgtgcctgtagtcccagctactcaggaggctgaggcaggagaatctcttgaacctgggaggcagaggttgcagtgagccgagataatgccactgtactctagcctgacgacaagagcgagactccgtctcaaaaaaaaaaaaaaaaggagggaaagaaaagaaagaaaaagaaaaagggaaaggagaaagggaaagggaagaaagaaaaaaggcacagtggaaccttaaatgtatattgctaagtgaaagaagacagtctgaaaaggctacatacgctataattccaactatatgacattttgaaaatgccaaaactatatagacagtaaaaacatcagtagttgccaagaagtgggtgttgggggtggggatgaacaggtggagcccaggggattttttagacagtgaaactaccttgaatgatcctgtaagggtagatatatgctatcgtacatttgtcagttccaccgaatgtacaacacaaagcttgaattctaacgtaaatcatggattttaattaataatgtatcaatattggctcatcaattgttaacaaatgtgtcacaataatgcaagactgggggaaagagggagggagtacttagaaactctctgtactttatgttcagtttttctgtaattctaaaattgctctacaaattgtctattaaaaacaaagccaaaaaaagaatccatgagacacggataatgaacggatagataagcagttaagaagggagggctcaggcgggcacagtggctcacacctgtaatcccagcactttgggaggccgaggcaggcagatcaccaggtcaggagtttgagacaagcctgaccaacatggtgaaaccctgtctctactaaaaatacaaaaattagctgggcgtggtggcgggcacctataatccctgctacccaggaggctgaggcaggagaatcgcttaaacctgggaggcagaggttgcagtgagccaagattgcgccattgctctccagcctgggtgacagagcgagactccatctcggaaaaaaaaaaagaagggagggctcttccttacagtagaatgcaggttggtaattgtggaaaaagtggtgggggtgggaaattaccactttgcataattaccactttgcacttagcagagtcaaaactggtgcagtcaggaatcatgaatggctgagaaatttatgggggaaatttgacaaggaacaagacatttgaaagatctccaagtgtctagccacagattgtctattggagacaccaggcagtggactaccatgaccaagtgaccaaaattactcatcttccaatgaatatcgtacacctccagatgtgacctctgaggacacaacatcactcacgtactatttcggctgtgggtgcataacctgaatctaatcatgaggaaagagtagataaacctaaattgaaaaatattctattggccgggcacggtggctcatgcctgtaatcccagcactttgggaggccaaggcaggaggatcgcctgaggtcgggagttggagaccagcctgggcaacacagtgaaaccctgtctctactacaattacaaaaaattagctggatgtggtggcaggcgcctgtaatcccagctactcgggagcctgaggcagaagaatcgcttgaacccgggaggcagaggttgcagtgagccaagatcgtgccattgcactccagcctgataacagagcgagattctgtctcaaaaaaaaaaaaaaaaaaaaaattagccaggcgtgggtggcaggcacctataatcccagctatttgggaagctgaggcagctgaatcgcttgaacctgggaggtggaggttgcagtgagccgagatcatgccattgcacttcaacctgggcaacagaaactccgtctcaaaaaaaaaaaaaggaaaatattctacaaaataaatgcaacagatgataagtcacgagctggattctagtctggaggaggaaacaattataaaagatattattagaacaactggcaaaattggaatataaactgtaatttcttttttcttttttttgagacggagtctcgccctgttgcccaggccggagtgcaatggcgcgatctcggctcacagcaactttcgcctgctgggttcaagcgattctcctgcctcagcctcctgagtatctaggattacagccgcatgcctctatacccagctaatttttgtatttttagtagagacggagtttcaccatgttggccaggctggtctcgaactcctgacctcgtgatccacccgcctcggcctcccaaagtgctgggattacaggcgtgagccactgtgcccggccctataaactgtaatttctgtcacttctaaattttctgattttggtaactacactgtgaatacgtacatattgttatacacattgaatactgctgctcttaggaaatacacactgattaagaggtaaagggaaataacaggcaacttactgtcaaatagtcgagaaaaaaaatgtgtgtttatgtgcttgtataatcagagagagagaaaaagagagaatcataaaacagatgtagcaaaatgttaaaaattggtgaatgtgggtaaaaggtatatagaagttctatgtactttttcccataaatttgaaattatctgaaaacaaaaagttttaaaaagtatgttaatctattttcttctggcataaacttccaaagtgttgctgtggaaaagtctgataacaatctaaattcattcccttataagtaacttattctttctgcccaattgttcaacatatctttcaagtgtagtaattctcttagaatttgtcttggtgttgggtgttcagagtcaatactctgagatacacagtgtgctcattaaaatgtgtattttcaattaatttttttaatttcagtaaagctttcttgaactatacagcctttactatttgttcattcagacagttgatggtaatataaacttaagcctggccaacatagggagatcctgtctctacaaaaaaaattttaaaattagcagggcattgtggtgtgtgactgtggtctcagcaactcaggaggctgaggcaagggcattgcttaagctgaggagttggaagctgcagcaagctatgatcatacaccactgtactccagcctgaacaacagagtgagaccctgtctctataaaataataaataaataaactttaaaacagactacaaatctgaaagttctattatataaaatagtaactttattatccattcattccaatatttattatctatgatatgacaggtatgcctattctacaaaaataagaaatggaaaataataccaagtaggtcaattaatcatctactgaattattattccccaaatgacttcaggttgttagtaatacagagaagcagtatattttagagtgctcagtttccacccattattttgccctacaactaccattctgtttaatcttaacacttgagtggtacagtgaagaactattctttaatatacataaaattcagcctgctaaacactctttaagaatgagatgaatattaaacaactgaaattcaattaataagttagagatccacttcccactgtttaaaaaggcacttagcactatattgacagtagagtcaaatttattttcacagtagagccaatttattactatgccataccaaatttaaatcagaaaaaaatcataactcaatttttaacattttaagactactgaagagccagaaataaacactcagtaagtattattagatatattacagaacaatttgaacaaagataattatcttaccatctccaaaagtatagcctgagttttagcctctttttctgcctttatttcttctacttcctcagctgatcttcctttgaaatcatcaatttcttcatctgctcctattcgaccactctgttaagacagaagttactcatgtatatatttaaagaataaaaaaatctgagaaacatagaagacatactttattcttagttatatcaaacatgctaaaacagtaactgatcaaggttgcagtgagctacaatcacaccactgcactccagctgggtgacacagtgagatcttgtctctaaaaaaaaatttttaataattaattggacagcaactgagacaaacttataaacctccaagaattgatttatattaattctaaaatattagccaaagtgggcttctgttaaaatcaaaataggccaggcatggtggctcgtgcctgtaatcccagcactttgggagaacacgcaggtggatcacttgaggtcaggagttcgagaccagcctggccaacacagtgaaaccctgtctctactaaaaatacaaaaattagctgggcgtggtggcatgcacctacaatcccagcaactcaagaggctgaggcacgagaattgcttgaatgaggaaggcagaggccacaatgagccgagatcccaccacgcactccagcctaggcaacaaagtgagactccatctcaaaaaaataaataaatatttatatggacactatttattatccaattctaactgctgaatgaagagaaatgatctgacaattaagcaccaatcccaaccataaagacaaattcagctttcaggaagccacataaaccttaaaatatgtgggggaacagtctgcgctgtttcacagaaatttctgggttctagcctggctccagagtgtccccagttgaaaagttacctcacaagataacagtttaatttgatgacaagaaaaacactttcccaaggtgttcatgtaagcttctagagctgaggttgtctcagtagaaaagaaactgaagaaaggaaattagagaaatgagaagacagctagaaaaatgagtacctctgtggaaaagaaaaagaactccaaacttgttgaatataattaagcaagataataattcggaaaaaattaactttaacagatgaaaaagataaatccatacaaatcattaatatgaatgtacatttaatcataagagggctttacttacatctaattgttcccttgtaggttctggtgatcgatcagggattaataaatcaggagggtcatcaaatggatcatctaaaatcaccgtatgatttatccttacaaaataaatccaaatcaaatgttatacattgaagttatttcagaatcctattttattttaatagattacaaaaaattacttgattatctctaaggccaaaaaaaacccatattgcatatggatattactaacctagatatactttcacaatgagtgttactgttttgcattgagtgataccatatttatcaccctgcattactttaagatgtaaactaatataactgtctaaatcttagtacttttgccctacttctcaattaaaaaactaaattaaagcattaacaattcctccagctgggtgcagtggctcattcctgtaatcccaacacttcaggaggctgaggtgggtggatcatgaggtcaggagatcgtgaccatcctggctaacatggtgaaaccccgtctctactaaaaatacaaaaaattagccaggtgtggtggcgggcgcctgtagtcctagctacttgggaggctaaggcaggagaatggtgtgaacccgggagacagagcttgcagtgagccaagatcgcgccactgcactccagcctgggcaacagcatgagactccgtctcaaaaaataaataaataaataattcctccaaacataattataaataattagtacaagtataaaaatacaaaaagtcctttttattataaagattcttacagtcttatattaattcaccttttgggattagaattatccagaaaccagtcctatgcataccgttcctatccataccactacgtgttaaacatctcaatattaaaacattctagtacattcagatagcaaattgtaaccatacctgatatcctgatatggtacaaagtccttgtcaacaaaggtctcattaattttcttaattatgtccatgccttctgtcacctcaccaaacaccgtatggacaccatcaagataatctagattttctcctgtggtgataagaaactataaagaaggacacataataaataccataaaaataatacataactcaaactgaaatcagttacagactgacaaaaaaatacatgaaagttaagagtccacatttactgcaccaattcttagacacttgttaccaaaactaagtaaaaagtacaaagcttatactggcatacctcattttattgcactttgcagatactgcattttttacaattaaggatttctggcaaccgtgtattgagtaagtctattggtgccattttcccaacagcataggctcacttcatgtttctggctcacattttggtgattctcacaagatttcaaactttttcattactattgtatctgttattaccatctataatctttgatcttactaccgcaattgttttggggcaccacaaactgtgcccatataagatggtgaacttaatccataaatgttgtatgtgttctgactactccaccaaccagccattcccatctttctccctctcagtgctccctattccccgagacacaatactgaaatgaggccaattaaccctacaagagactcttaagtgttcaagtaaaaggaagaatggcacatctcttactttaaatcaaaagctaaaaatgattaagcatagtgagaaaggcacgttgaaagccaagataagcggaaagctaggcctctagtaccaaacaatagctgagttgtaaatgcaaaggaaaagttcttaaagaaaattagaagtgctattccagtgaacacatgaatgataaaatgaaacaggcttactgctgatatgaagaaggttttagtaatctacataggtcaaaccagccacaacgatcccttaagccaaagcctaattccaaacaagccctaactttattcaattctataaaggctgagagagggaaggtagctgcaaaagaaagtctgaagctagcagaggttaattcatgaagtttaaggaaagaggccaggcgcagtgaattactccatctcaaaaaaaaaaaaaaaagaaaagaaaaatttaaggaaagaagctgtctccataatttaaaagtgcaaggtgaagcagcaagtgctgacacagaagctacagcaagtggccaggtgcagtggctcacgcctatgtaatcccagcactttaggaggccgaggcaggcagatcacaagctcaggagttcaagaccagcctgaccaacatggtgaaaccctgtctccactaaaaatacaaaagttagccaggcatggtggcgtgtgcctgtaatcccagctactcaggaggctgaggcaggagaattgcttgaacccaggaggcgaaggttgcagtgagctgagatcatgccactgcactccagcctgggcaacagagtgagaatctgtctcaaaaaaaaaaaaaaaagaagctgcagcatgcatcaagttatctggaagatctagctaagatcactgatgaagatgacttcatgaaataacaaattttccatgaagacgaaacagccttatattggaagatgccacttaggactttcacagctagagaggaaaagtcaatgcctagcttcaaagcttcaaagacaagctgactcttctgttacatgctaatccagctggtgactttaagttgaaaccaatgctcactgactataccaaaaatcccaaggccgttaagaatgatgctaaatcggccgggcgcggtggctcacgcctgtaatcccagcactttgggaggccgaggcgggtggatcacgaggtcaggagatcaagaccatcctggctaacacggtgaaaccccgtctctactaaaaatacaaaaaattagccgggcgtggtggcaggcgcctgtagtcccagctacttgggaggctgaggcaggagaatggcgtgaatctggaggtggagcttgcagtgagcagagattgcgccactgcactccagcctgggcgacagagcaagactccatctcaaaaaaaaaaaaagaatgatgctaaatctattctgcctgtgctctagaaatggaacaacaaagcttggatgacagcacatctgtttacagcagggtttatcaaatattttaagatcactgttgagacctgccgctcagaacaaagatccttttaaatatgactgctcttttaataagaaatccttttaaaatattactgctcattgacaatactccaggtcacccaggagctctgatggatatgatgtacaaggaaattaatattgttttcagctgtgcacagtgactgacacctgtaaacccagcactttgggaggctgaggcaggtggatcacttgaggccagttcaagaccagcctggccaacacagtcaacatggtgaaaccccatttctactataaatacaaaaaatcagccgggcgtagtggtgcacacctgtaatcccagctactcagaaggctgaggcaagagaactgtttgaacccaggaggcagaggttgcagtgaggtgagactgcaccactgtactcaacctgggtgacagagtgagaatctgtctcaaaaaaaaaaaaatactgttttcatgcctgctaacataacagtcattctgcagccatggatcgaagagtaatttcaactttcaagtattactatttaagaaatacagcctgacatgtggcatgcacctgtagtcccagctactcaggaggctgaggtagaaggatcacttgagcaacgtagtgaggccccatctctaaaaataaaaattaaaaaaaaatacattttgtgaggctatagctgccatagatggtgattcctctgatggatatgggcaagtacattgaaaaccttctgaaaaagattcaccattctagatgtcattaagaacattcgtgatttgtgggaggaggtcaaaatatcaacattaacagaagttaagaagaagtagattccaaccctcatggatgactttgagtggctcaagacttcagtgaaggaagtaactgcaaatgtggtggaaactgcaagagaacgagaattagaagtagagcctgaagatgggactgaatgctgcaatctcatgatcaaacctgaccagatatggagctccttcttaaggatgagcaaacaaagtggttttcttccttttttttttttgtttgagacagtcttgctgcatcgcccaggctggagtgcagtggtgcaaagtcggctcaccgcaacctccacctcccaggttcaagcaattctcctgtctcagcctcccaagtagctgggactactggcgcctgccaccacgccgagctaatttttgtatttttagtagagacggggtttcaccatactggtcaggctggtcacaaactcctgacctcaggtgatccgcccccctcagcctcccaaagtggtgggactacaggcatgagccactgcacccagccaagtgatttactgagatggaatctactgctggtgaagatgctatgataactgttgaaatgacaacaaaaggtttaggatagtacataaacttggctgatacagtagtagcagggtctgagaggattgacttcaatcttaaaagaattctactaaatgctatccaacagcatcgtatgatacacagaaatctttcatgaaaggaagagtccatcaacatggcagacttctgttgtcttatttatttatttatttgcaagacaaggtctgtcacccaagctggagtgcagtggtacaatcacagctcactgcacccttgacctcctgggctctagtgatcctcccacctcagcttcccaagaagcaggaactacagccctgtaccaccatgctcagctaatttttgtatttttttgtggagatggggttttcaccatgtttcctgggctggtctcgaaatcctgagctcaacccatctgcctgccttgcccccgcaaagtactgggattacagatgtatgctaccacgccagtcagttgtcttattttaagaagctgccacagtcaccccaaccttcagcaatcaccacccagattagtcaacggccatcaacatcaaggcaagacccttcaccagcaaaaagattatgatttactgaaggctcagatgatcagaagcacttgttagtaataaagtattttttggtcggccacggtggctcacacctgtaatcccagcactttgggaggccaaggcaggtggatcacctggggtcaagagtttgagaccagcctggccaacatggcaaaaccctgtctctacgaaaaatacagaaagtagccgagcgtggtggtgggcatctgtaatcccgctactcgggaggctgaggcaggagaatcgcttgaacctgagaggcggaggttgcagtgagccgagatcacaccactgcactccagcctggctgacagagcaagactctgtctctaaataaataaaataaaataaaataaaacaaaatacttagacaagccatgactcaacttcatgtgtatatagtagaaaacagaagtacctactctaacaagtaggtcattgggagaattaacagggtcattgggagaattaaacaagacaatgaatagaaggtactctgcgtaatgtttttaaaaaagtaagaaatactgaaaaacggccaggcgcggtggctcacgcctgtaatcccagcactttgggaggccaaggcaggcggatcatgaggtcacgtgattgagaccatcgtggccaacatggtgaaaccccgtctctactaaaaatataaaaattagccaggtgttgtggcaggcgcatgtaatcccagctattcggaaggccgaggcaggagaattgcttgaacccgggagggagaggttgcagtgagccgaggattgtgccatcgcactccagtctgggagacagagtgagactacatctcataaaaataaattaattaattaaataaaaagaaatactgaaaaatgagccacaaatgtgaacagtgataatcacggatggtggagttgtaggtaatgtttttctttgtacttttctgtattttctcaattcttcacaataggaatgctttacatttaaaagaagaaaataatattttttaatatagaaaaagtgcattttttcccctaacacatatttctgattgaaaccctctaagccttactggatagtttaaaaaataactctgtgggctccttccagtccttcatttctaagcaaatctcatattcttactcatttcctaacctgagatccatgttgatcactgccattattcaccatggacactgtgcctttcttcttgtgcttaattcttgggactttttctgcctcaaaaaagcttgcttgatcaccatacagttggctgaaaaaacatataaggttataaatgtaagtactctcaaaatgaaatacagaagtactagtaacatacagggttatcaattatttctttacagaaatgccaacagaattcaaaatattacttttttttttttagggaacttgggggaaaaaatctaaatttaaaccatattttaaaatgcagattgaagcatgagcaattatatttttcctcatttaagaataaaagaatttgttctgcccttccagaggttaaaagtaaataaataaataaataaataaataaataaataaataaaacaacttacccaaagatagactctcctccacggccagtccctgtaggatcgccagtttgtatgataaaatccctctgtaatatgtaggattctttgttaattcacagagtttgttagatagttccaataacaaaggaaatgactaatatctaccaactcacctgtacattgtgaataaggcaataattgtaatattttattttgcacagtttcaagaaattcaagcaggctgaaagaaagtaaataccaaatttatcacagtaatccacaaacacatttttaaataagtaaagccacagtaaaatgtaatttctaaattactattaaaagaaaaaaaaagtcaaatgtccaaagctataaaaaagggcaataggccgggcgctggctcacacctgtaatcgcagcgctttgggaggcggaggtgagtggatcacttgaagtcaggagtttgagaccagcctggccaatatggtgaaaccctgtctcaactaaaaataccaaaaaaaattagccaggcatggtggcgggcacctgtaatcccagctactagggaggctgaggcaggagaatcacttgaacccaggaggtggaggttgcagtgaaccaagatcgcaccactgcactccagtctgggcaatagagcaagactctatctcaaaataaaataaaataaaataaaataaaagggcaataagtctagaaaaaaaacattttaaattacctttttttttcctttaataggagttttggggcatctgggctaatacagaaaactgacacttataagcaatcatttactgatggattgattttattacgagaaaaaagaacacttaaagagcatattgtagtagaaaaggatctagcagaatatataaaaatggatacggattatatcaattaggaaaaagtcaaacacccggggtcattttttaaataatagttaaacagccctttataaaaatccatacacttatgaacaacctttctcatacaagttaatctgcttatccaataaacatttactgagtaccttctagatgcctgacactgccatcacaaatgccattaaactgtggtccctgctcccaaaaagttcacagtctagtcgtggaaagacacattaacaagctcttaaggcactaagttagaaaccaaacagacagtaagatatatgaggcaatccctgccctcaaaaagcttacattaaattagggtccttacatctgaacacaagtagttacatactgggcatatctaattaataacatgtgtgccacttatttaaaatggtaaaaaaagtagttttaaaaattccacaagagttcaaaagattgtttctggctagggaaattagaaaacctcagggaaggttaaggcaagcattaaaagaactggactagcagagagtgaagggtgagcattttaggtctggaagactatgaaaaggcctggaagtggaaatttaaatgttttaggggaggtccaaaacaccaaagttctgtaatagtctggtattacacagtaatagagcatgaaaagactggagagataagatggggctgagctgttgaagagtgctgaatatcagtcttgcagttgtttttcttgaatatatttctgggcttcatgtttaacagataggggtggtccttttactagaaacaaaaataatgaatttaggcaatgatcatcaatggctgccaaaatctttaggtctttcatcaaaatccgatgggaacaatttataagcgcaacaaggccttaacccactgaccaattttaacatcacagagccaaccagacatcaagtgcctcctgaatgtgatgcagctgaaagtacacactatcttatatgaaatattcttgccaaaaacattaaactggaacctaatcaaggctctgaagctaaagaacaatttataggaaacaggggacacaaaaatatgttaacgcacccagtaaataatcagtcgaatccaaacaagagaaattctacaagacaaagcacccaggttgtttctcaaaattttttcaaggaaaaaagggggagaaccaatagattaaaacatatatgagacattttaaccaatatatggactttgggtcctaatttaaatcaccatattttttagaagtttatgagataataagaaagtttaaatgatactaaaaattattgctagttttttcaaagtgtgataagatctgtggttctgtttttttattcttttttacaactttttctctttcctttagtatttttcccttttccctgtcaagttttttttcttttttaacctgtcacttatgtggtacttaagctcatagttccattttttcttgttttttttaaagagacgttatattttagaaatacatactgaagtaattacagattaaatagatgcactggaggtgggggtattataaatgaagcaagattggctatgtgttcacagctgttaaacaaagctggtcatgtggacatgagagttcatttacatgattctctctacatctgtgttttaaattttctataataaaaagttaaaaaagaaaaggaagaaagaatggaaggtaggtaagtctggatatgttgatcatagattgataagtgagtataaatatagcaggtacacatgtaagcacatctccagtcatatgcttacaaatatgtacagggggtggacttattgttatgggcttatctttgcagacccactgcttgttaattgggtggggtagctctacacccctttatttcctcataactctgggaaaagaggcccatttattttgccaggtgctactctacatgggcagagcgtcaaaggaactcaaagaaaagcaaaatcaagagataaaaaacaaaattccctatgatattctttgaaacactcgatccagccactcgatccaagcttaccccagtattatgaggcaaccaattattttgtttatgccagtttgagttgggtttctatcacttgaacaaagggtcctaactaatacaacacatttatatccattagtcatcataatgaacctctagtgtgtgccctaaaagtagcagacattgtactgggtactcaggatatagagatgataattatggtatagttcctgctctcattggagtttacattcttgagcgagggcacgcttgtaaacaacaccaggataataggtaaatgttaaaataaaatgtgtcatgtggtttataaaagacctaagacacagcagaggaaccctcaggtaactctgcttagaaaggagggagagcttcaaagaagagatgatgcttgatctgagatttagataataagtagtaagtttgccagaaggacaatagtggagaagaatattgtttagaagaaacagcaaaagaatggtaacaatggtacgggagagtttgtagtgttttcgccaggtggagaggagggaggaatagctgcgtgcgagggaaagcggagcacggcaggaggtagttattgtacaatattgcaacttatttcaccttctttgataggctctgcattccatgtgggtaggaccctgtttgtaactaatctctcctggtctcagtttcttcctgactctgatacattctccacaccgctgcctattatcttctcaaaacaagtatgccatgcctcaatcctgcttttaaagtcttcaaggactctgatcatcagtagggcacacaagactattcacgactgacctaggcgtatctgaccacactcgagtctaccattccacgactcacaccagtccttccagccacaccaaactacttgccgtttccagaaaattccaaacaaagaaagtccaagctaagaaaaccctcattcccattcatctttgaaagaactagttcaagtgttctatatagtattcgctagctttgcttcttcccaccccccaccaaagaagccgccctcttctggtttccgtggcaacttacacattcttctaccataacacatagaaaactaaaatgggttcctgtgtctacttcccccagtggaaaaatcagaccctcgggggcaagaagccaagcccaggacttagcccagtgcctcgaaggctcagtccacactccagacaacctcttcctcctccacctaagcggtatgcccacactcgctgcgccaagcacaccctaactgccttcatcaagatttaaccgattacacaccaagcaatagttcctatgttcctctcacgagtaaacacaataaaggcacaaaagctatgggtattgtatgtgcagctcgaatcacacacacacacgccccacacacacactcccaaaggcaattaatgaccgcaagcaccgtccaccggactggccaacacaaaatacgggagaagggctgccaaggctcaaacgaattcccgtcacaaaaacttttctagccaaggccggttaataaaatagcccagtcgcgggcaccagcagcccagaagctcgagctctagccaatctctgccctggactgcgcagagaagggaaagtagggagacaagctcgggggccccggcgacaggtgagtggggctcaagcctcaccacgcggccgttcttcggtgtacaagtcgatgacgacgtcgcctaaagtggtctccagtagaaccgccatggcgcccgctcctcctccgctacaaaccccgggaggaggggggtgacaggcgcaggccgacggcgtcgtctacgccacgcgtcaccctcggcgcgac

SEQ ID NO: 946 - DNA, 165175 bp, Homo sapiens
gctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagattaaaaaaaaaaaatagcagagcagagtcctgtcttgagggtttcgtttttatttttgagatcactgatgatatttgtaagacaggaaaagaagaatgtgcaaatccaccctctgcagggtgaacgccatcagaagcctttgctcaggagagggattccggctctagaaccagtccacatcaccctggagatggcttcgtttgccacctgctagctgtgcaggcagcctgagaaacagaagatggtgggcgagaggaggactgactaggaaagggcgaacatcttcctgcctggccactcctttcagaaacagatctgatgctgtcacttgtttacttaaaaactccctcgcttttctttttcccatgggatgaatgaagcctaaaatgccttatcaggtcatacaaagcccttgacaatcttgcctcaatttactcctttacttttagcctaatcggatcctccaattctccttcccctcatcccgcttgctggctagtattcagagctgcttgactgccccctcacatgttgggatgtttttgttttatgtgatcctctttcttccccacctttacctgccaagctccactttttcttttaaagttcttctcatttgagaagcttcttgcgggcaggagctgtgtcttgcccacctttctatctcccgtggtgggagaatcctccaagttgtcttgtagattctttccaatctcttctctcttatgcctaggctctgtttatttcccggtatccacttcccaagagattttttcgtgttttgaaggcctgcttggagtacatgcccaggacttttagtatttctgattcccggcttccccatgtccatcccacccagcccccataagcagtcagcaggtgggaactggtaggtcccatatcccactggcctccaaaaaactgtctctgaaagactaaaagcccttcagtctcttttcacctctgcctgctcaaagtgacctggctgataccgtgcattgtaaggcatggtgggatcccggggcctgttctctgtttagccacttaacatctgggtgaaatacagaaccagaaaaaccacccctctgacttcagtacattcatgtgtcttccctttgccaggtgaattgcttgggatacaaaagtgaggaagtcagtccttaacctttgaggaactcagagtctaatgtaggacaggtggatataaatacatcacaggtgctataagattgtgataataataatagctattttttatttgccttgtgacaagctatgtaatgttttccatgaattccctcagtcttttcaacagtcataaaagggcttattcctactctacagggttggaaactgaggccaaacagtgggcaaatgagggaatagtcaagatttgaattttggccgtgtatttgcagagcctctgccaggctgtgtagggagcatcccctgcctgggtgatttgggaaagctttcctgggacgggggggccttcggatcatgaaggatgcataggagtttgcgcgtggtggactgcacacataggcaagagggagcagcacaagcaaacttggtggtggaaggaatccactgtccttggggaggagggaagaggttaatcatagctggatcaggtaaggacaatggagagctactagaggatttaaaggaggtcagggacttgggctgaaagaattttggaaagatcatttgggggcaatatagggccaaatgcagatgcccctgcaatataggaggcactggttgggtctgacagaggtagagtcacagcctcttagacccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtttccaggttcttctcttacagcaatgaatgtccttgtacatactgtgttatgtgctcatttgcaaagttatctgaacaatatgcttttagaagtagaattactgggtcaagggatatgtctgcatttttgatttgcagacatggagccaaactgccacccgtttctggggggttgtaccaatttatcctctcccccaaagtgtatagctggatagatgatctttggagaattcaggaggatcaactacgatgctttttcagctattatatgcctacttttcctccacaaatcctcccccaccctatgcgattctagccagtttctttgaatttacagagggagatgttgaggctcagaaggataaaagtaacttgtgcaggatgatcagtgcgggtggtggtgggtgttttgttttgtatttttgcacccctcatgtttgtatttgccagcacctttcattggaggtgctcagtgtcagtttgtaaacattattgcattatttttctccattttcacatggaaaaaaatgagatgcaggggaagtttgagttatgagagggaaactggccaaatatagaatcttgtcattttacttccagtgcaataataaatgtttccaaatgacaaagctgaagagatgttttttgtttgtttgtttgtttgtttgttttttgagatggagttttgctcttgttgcccaggctggaatgcaatggcgctatcttggctcacgcaacttttgcctcctgggttcaagcgattctcctgcctcagcctcccgagtagctgggattacaggcatgtgtcactgtacctggctaattttgtatttttagtaaagacggggtttctccatgttggtaaggctggtcttgaactcctgacctcaggtgatccgctggtcttggcctcccaaagtcctgggattacaagcatgagccaccgtgcccggtgaagaaatggttttttagtgagtctgagtacaacaaaaatagcaataatataacactaacttaataaaactgaacagcaggcccaaaaatagcccaacattaaaatttattttaatgtattctctatggaaaagagaatccattaaatgtaaaactatttattttactctaaattcacatccatttgtgtcagtgtacaagacataatttttatagtagcagtcagtacatatagaatatgatttttgaattcttcaatagcataaaatattttatatttactcatttaagtatttgttcatttaaaatcacaggctgggtgcggtggctcacgcctgtaatcccagcactttgggaggctgaggcaggtggatcatgaggtcaagagatcaagaccatcctggccaacatggtgaaaccccatctctactaaaaatacaaaaattagctgggtgtggtggcgcgtgcctgtaatcccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcgacagctgtagttttttttaaatttgtttttgtttttttgagacagggtctcactctgccaccctggctggagtgcagtggcatgatcacagctcactgcagccttgacctcctgggctaaatgatcttcccatctcagccacctgaatagctgggactgcacaggtctgtgccaccacgaccagctaatttttttattttttgtagagacatttttatgttgcccaggctagtcttgaactcctggactcaagtgatccacccgccttggcctcccaaagtgctgggattacaggtgtgagccaccactctcagccaacagctgtagttggtgcaatcctttttattcttttatttttttctacctttttgctattataaatggtacttttataccccttgttcaaatacttcttttggattatttccttggactcttactcccaacctgggctcaccaagtcagaggatacagtttcggtgcctaattgcaatctggaaaggttgaactagtttccagcactatcagcaatttatggggccatttcttgacaacccatctagtgctattacaaagaaatgtaatgataccttgaattaggtttaatttacattgctttggaaaaagagaccagtagctgatttagattttttgaaagaagtacagtgctgtgatatagattatctccaagatttatgtaactgaagccaacttgtggttgaagaaagatttggttgatgagattgaaatattgtggaagtttagaataggatcatagcagtataaaatataaggctagatgctgttcagttggaaataccaggcattgtgccggaagctggggacaccccagagtaacatagatgtgatgtctgtcctcatgacacttttaggttagtgcagtagacagacattaaaatcacctatggtaattatagatgtgatgaaaggggaagaatagggtgtcgggagtgtcagagaagttcagcagctaaacaacatttgcagttaaacatttgtgaaggccctgagctgagaagggatttggtagctcagggcagcgcttcgctaacttgaatgtgctcatgaaccatctgggaatcttgttaaaatgccaagtcctgaatcagtaggtttggggtgggacttgggattctgtgttactaaccagctcctgggtgaggcagatgctgctggtgggtggatcacacttggtgtagcaaggcctaattgagagcttggtgagcacctaaaactggctgaccatggtgagcaggaaggggcaggtggcttgcagtgacagagtaattctctgcctaggctgcactttagattcacctggggaacttagaaaaatcagggttgcaaatgccccacccgcagccattttaatttaattggtctcagttggggcctgagaatgtgtatacagtcatgcacagtataacgatgtttccatcaaggagagactgcatatgccacagtggtcccataagattataatccataattttactataccttttctatttttagatatgtttaaatacacaaatactcactgtgttagttacttacagtattcagtacagtaacatgctgtacaggtttgtagcctaggagcagtaggctatacaatatagcctagatacgtagcaagctgtaccatctcattttgtgtaagtaccttttatgatgtttgcagaattatgaaatcacatcaggactcatcctcagaatgtgttccattgttaagtgatgcatacctgtatatatattttaactccccaggtgattctaatgtgtagccaggcttgagaactagagactaaggacagtgttgagactagagaatggcaaggagcagagttgagggtcctgtatggcatgcaaggattttggactctatcctgaaggcagagctaaatctttgaaggatttttaagcaggagagtgaactgatctgatttgcaattgttaaaaagttcactgtggctgtagtccagagcagtagttttcaaattgaggtagataagatgatccaggggaactggaagaaaatttagaactttttattgtttttatctaaaagataagataaaacatttaatttaggaattgtctctggcatcttcttgggtctataggtcaaacagttaatgtgttaactgtagaactttgggtgtcctgaaggaagagactgaattctgcagtgagcagagacatatttatacatttgttctccatgtattgcaacatgttgttaacagtttatattaaccagttctcattgaactagcctttacaaaatggacatgcagagaaaccagtgatcaaagaaaatactaataatacaagcacaagcaaacaagttgtcagagctgacacttgtccaactcctgtgatgaattcttggtgagctattcaaataagtcagctcttactaaattggaaagtatcaggaaatttataagaaacatgaactttcgtgctctgtcattaataggaatcttgctttaagattccttttaatcgtatgtagaacccagctgcacggtggctcacacccataatcccactgttttgggagcctgaggtgcaggaggccaggagctcaagacaaacctgggcaacatagcgagaccccatctctaccaaaaataaaaaattagccgtgtggtgtcacgtgcctgtagtcccacttacttgggaggctgaggcagaggattgcttgaacccaggagttcaaggctgcattgagccatgattgcaccactgtactccagcctgggggacagagggagactctgtgtctcaaaaaaaaaaagaggaggaccgggcatagtgggtcacacctgtaatcccagcactttgggaggtcagggtgggtggatcacaaggtcaagagatcgagaccatcctggccaacacagtgaaaccccatctctactaaaaatacaagaattcgccgggcgtggtggcgtgtgcctctgggtaatttcagctactcgggaggctgaggcaggagaatcctctgagcccaggaggcggagtttgcagtgagccgagatctcgccactgcactcaagcctgggtgacagagcaagactctgtctccaaaaaaaaaaaagtatgtaaaaccttgagatattaaataataaaatatgaggctgtcaccagtatgaagacatttgaaaaccaaaaatttggaacataaaaagaacctctacattttttttgcagtgatgtttaaagataaaggatattccatcagatgctttacaaaattttgctaacttcaattattaaaatttatattttgagggttttttgcttttaagagacagggtctcactctgttgcccaggctggagtacagtggcacaatgatagctcactgcagcattgaactcctgggctcaagcgatcttcccaccttggccttccaaagctctgggactacacatgtgaaccaccatgcctggccagtttttaagtttattgttcttataaaagacaaaatggggccgggtgcagtggctcatgcatgtaatcccagcactttgggaggccgaagtggacggatcacttgaggtcaggagtttgaaaccagcctggccaacatggcaaaaccctgtctctactaaaaacacagaaattagccaggtatggtgggcacacctgtagtcccagctactcgggaggctgaggcaggagaatcgcttgaacctgggaggcggagattgcagtgagctgaggttgcgccgctgtactccagcctgggagacagagcgagactgtttcaggggaaaaaaagaaaaaagacaaaaaaacacatacccttggcagattcttcctgccccacccccaaaaggcccacttaaacaaaaaatggactgatgtactacatggaaaataattttgtcaggaaatcaaaatactgttggaagatgtatagaaaacattgctgaatatgtgaacaaacaatattagaacaaattttgcagtgtgggaagtttggtatacggttataaaagtacagaagcttctagcatgtctcagtatcgctagatactcttttttttcttttctttctttctttctttttttttttttgagacagttttgttctgtcacccaggctggagtgcagtggcaccatcatggttcactgcagcattgacctcccagtctcaagtgatcatcctacctcagcctctcaagtagccaggaccacaggcatgcaccaccatacctattttttttattttttatttttaggagagatgaggtctcactatgtttcccaggctggccttgaactcctggctcaagcaatccacctgccaaaagaccttccaaagtgctgggattacaggcatgagccaccgtgccaactgtgccaggcctagattaccttttaatagttacatccaagaataaggaccacttcttttgtgagctactggaagaaagttgtactggagaagacatatttttaatagtaaatgattgccttcataagaacattactatatggaataatagactgaatgtaaattaatggaacagctgctttgactgaacaaaagaatgaaattcattcattacttctctatgggcaggctgttgagtccacttatttgttaattatcttgtggtagagttgttgatgagttttgcatttttcttttttaaaaaaatgccaactttttgttatggtaagtggctacagtttgagtaatcctaatatgaaatccaaaaggcttccaaatccaacactttttttttttttttttttttttgagacaggttctcactctgtatgtagcccaggctggagcgcagtggcatgatcatggctcattgcagccttgacctcctgggctcgggtgatcctcccacctcagcctcctgagtagctgggactacaggcatgcaccaccatgcccagctaattttgcaaccagtaggaataatgcaaatagtacaaaatctgaaaaatacctaaatctgaaacacttctggtcccaagcatttcagataaggaatactcaacctgaacctagcaaatatcatttgaaaaaataatatcttaatctgtctcttcaagtaaaagtattatttaaatagtgagtgaaaaaggaactacttcttttcttagaaagaaatgtgcaggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagaaagaaatgtgcaatggtagagcgttttcctcgttggaattttttttacatgtaatcattataagctataacttacatattataaaattctcctttttaaaatgtacagttctgtggttttttgtatatgcatagagttgtgcagcttttgccactgtctagtttaagaacatttcatcaccccaaaagagaccctgcacccattagcctcacttcccattctctcctccctccagtccctggcaactactaatcttcctgtttctttggatttgcctattctggacatttcatataaatgaaatcatacaatatgtgaccttttgtagctggcttcttttacttagcataatgtttctggggttcattcatgttgtatcatgtatcagtacttcattccttcttatggctgaataataatccattatattgatatacgacatttggctaactggttcatcaattgatgaacatttatttgtttctactttttggctttatgaataatgctgctgtgaacattcatgtataaatttttgtgtagtcataggttttaatttctcttgggtatatatatatacctaggagtaggattgctgggttaaacggtgactaactttgaggggctgtcaaactgttttgtaaagtgactacccattcccagtagcaactcacaaaggttccagcagcaatacaataggggtccagtttctcccagcaatgcttaggggtcccaatgtctcccatctttgccaacatttgttactctctttttgattatagccatcttagtgggtgtgaagttgtatctcattgtggtttttatttgcatttccatgatgatttatgatgtgcatcttttcatgtgctgttggccgtttatgtatgttctttggggaaatgtctgttcagatacttggctcattttaaaatttagttattgctctttttattattaagttacttatatatttttagatataagtcccatatcagatatacgatctgtaaatattttttcccatctgtgggttgtgtgttcagctgtttgcgtggacatatccttttgggtagatctaggagtggaactgctgagtcaaatggtaactctctggttttttttgttttttttgtttttttttttttttgagacggagtctcgctctgtcgcccaggctggagtgcagtgacacgattttggctcactgcaagctctgcctcccaggttcatgccattctcctgcctcagcctcccgagtagctgggactacaggcgccccccaccacatccagctaattttttgtatttttagtagagatgggatttcacagtgttagccaggatggtctcgacctcgtgatccgcccgcctcggcctcccaaagtgctgggattacaggcacaagccactgcgcccggtttgaggaaccactgactttgttgaggaacagaaagaacgcctgcacctttttacaatcccagcagcagtgtatgagtgtatcagtttctccatatccttgtcaacacttgttgttttttttaactgtagccatcctagtaggtgtaaagtggtattgcattatgttttaatttgcatttccttaatgactcatgatctgactgtgattttgttgcatctataaaattctcataatttgacacatgaaaaccttagaaacaattttgtaacctaataaaaatctccaaatgtgtttctaaaaacatttccagatgatctaatgaagtaaagaatctaggcattggtcaccagtggctgttaaaaccattagggaactttataataaagggatcagtgtgacaatcttctgatcaatcataacatctctaaaattgggacaaccaaatcttatattctttctatgtgatactaggaagaacatatcattcatgaaatagtcttgcttgccccaacaaacagagtcaaaccttcctctgattagtgtagatctgattactggtttataggatataattggcaaatttagaatgtgaaaaatattataggacaaatgaacccatttacttcaaatgaatggcaagaaaaaaaaagtacacgaactgctacagattaaaaaagacttgaggctgggcgtggtggcccacgcctgtaatcccagcactttgggaggccaaggtgggtggatcatgaggtcaggagttcgagaacagcctgaccaacatggtgaaaccccgtctctactaaaaatacaaaaattagctgggcgtggtggcacgcacctataatcccagctactcgggaggctgaggcaggagaattgcttgaacccaggaggcggaggttgcagtgagatcatgccaccacactccagtgtgggcgacagagcaagactctgtcttggaaaaaataaaaaagacttgaatgaaacatattaattgaacataagtatagatcttgtttagatcctgtttcatgcaaaccaactgtaaaaagttatttatgagcccattgggagtaatttaaatttgaaaaccacttgtatattagatgatttttaaacaattttaattttttaaaggttattatagtagtatggttacattaaaaagaaagactcctttctcttacagataggtactgaagtattttggatgaaatgatgttgatatctggaatttgctttaaaataattcagcatgtttggaggattacagacgagacaagaattgccatacgttgataattattgaagctggataataggtatataagggtttattatagtattttctctactgttgtatatgtttgagaattcccatagtaaaaaattaaaagagaaaccactgtaagggaagagttttagtggatttcatgtccatttgttagaaatagaaaaatgtggccaggcacggtgactcacacctgtaatcccagcactttgggaggccgaggcgggcggatcacctgaggttgggagttcgagaccagcctgaccaacatggagaaacccccgtctctactaaaaaaaaaaaaaaaatacaaaattagcctggcatggtggtgcatacctgtaatcccagctactcgggaggctgaggcaggagacttgctttaacctgggaggtggaggttgccctgagccgagatcgcaccattgtactccagcctgggcaacaagagtgaaactctgtctcaaaaaaaaaaaaggaaaagaaaaaaaagaaaaagaaataaaaaaatgtagtatctttgattaattttcaaaagtatatcacagaagatagatatttgctagccatatttaaaaggaaatatttgtataatgggggtgaaaaaatgattatcacagtttagtaaacacagccatagtgcttcttcctttggattcatgtttctttttggttatgatagcattaaaacttggaatcaggcttttaaattgctctataatatattaaaatgagatttttcaaacataatgagaaatatttaatcatatggattgcactaaaatatttttaagatgggttttacattactattttaattgatggaagtaccattattgtgatcattatgtatttcatttgaaatgttttgtagtatttataggtattagtacctgtgttctgtttataaatgaacatgtgttggggatgtatactcttatttattggtggatgtgcagtaaaaggtttgtttgtggagaacggactgggcagggtatagagacttatttgatgtttattagagcaaatgtggccagtgatgatggtgttctggattggcttagggtgggaggagtggtgatagggatggagatacatggacaagtatgatttaagcagtagaggcattagggttctagatttctggctttttggaagagatgattgctagttaatgaactgagcttttgtgtgtgggaagaagttgaaacctggcccctgtgaattgtgcaagtagttcttaaatattgattgacaaatagcttaacgagcaactaattttcaaatattggttgacaagtggcttattacaatattgtaaatgcattgatactaccattagtaaagagaatgtcttcctttgataatgttagcagcactgttaccagagcagtgtgggatagttccaggactttcactgtctaaaaggaactggaggcccaagcttttacggggatacttctgctctcctggttcccatgtccccagtgatgtgaatgtccctgactcagtgcctctgctcacgctgtctgtgagatcactgccttccagtgcctcttacctcttgggcctgcccactttgttaacagggacagatttcacagtgatttccagccagtatttctctctccccagtttggggtgttagctagaatggtccctcaaagccctcaaacacggatgagaaatagaagaagctcagggagactatacctgggctaggttcttgctaccagctggtggaagacaaagaaaaccccttttcttcctgtatttcatgcccagtgagcagtagtgccatcagcagcagttgtgaacccctaaatcagtgattctcaatatgactgacatggtggggaagacgtaagtttgaaaatgcattttcaggctaggtgtggtggctcacacctgtaatcctagcactttcggaggccaacatgggaggatcacttgagcccaggagttcgagaccagcctgggcaacatagtgagaccctgcttctacagaaaaataaaagctagccaggtgtaatggcatgcacccatagtcctagctacttgggaggctgaggtgggaggattgcttaagcccaggagatcaaggctgcagtgaacataccacagcactccagcctgggcagcagagtgagacccctgtctcaaaaagaaaaagcatttaaaaaaaaaaaaggtttgttagtgtttgtctcaaaattttgcttaatttaaaattatgtatatatttgaataatatgtgtccatgttaatagttctaaaagtatatatagtatatatagtaaaaggtagttttctctccccctgcctttcagctttccctttccataggcatccacaagtactatgagcaatacttgtgaaaccatgctgaaatactacatgctcataaaatgtaagttacttaagtttggtatttcaagtaacaataagggaagataggagagttttatgtttatcaaaaggggtgaatgttatagcagattgagatgagatgttcttacctttgggtgggatcttaagtggagctcaattcggtttccccaatgttagtgggagagattacttaaaccatccatacttatccagttgtacttggtaagttttcaaaggttctactttgaagagggcttttgttgagcaagtagtggttaatagagcagctcagttacatgtgtaagttttttgatgtgggaaaagggcttttgtatacagaaggactattttaaaattatttgggctttaaattaacatgtattaaagtggtaaatttaaaacccagttttcttttagtcttgttattgtacttgtaagcataggcattttgtatagaaataagaatagtaattttcacctgcttgtcaattaagttaatataaatttaacagatttaattgctccaggccccttacttagtgaattaaatttccttagatgtttaaaatacatttacacagtcagtctgtcaggcacagtcagtccttgacaggtcagagttaccaccttaaacagaaacttcttaagctcttgggcaatctgtgatactaagaaattaaatttgtaaatgtagtaaaacaggttttggttaagacttccagtgcttttcattagctgaatctgaattaccaacatttaaaaaacacataccctaaacttaacgcaaaagtactactagtaccatgagtttgatataccatacctcattttattgctcatgtcttttctttctgggattgtgatgccacttacccaattaaggaggacagttttatcatctcagaaagccatggttatcagattaaaaatacagaatcatgatacagttattattggtcagagatttgagactgggaaagggaactaaggggtctgtgtttccaggataattctactcaagagatgctgtgcctttccttatgttaagagtcctgaatgtggcatcaaagggggaatccatgttcagagtttgttttgcaaccccccatacctttttttgagacaggatcttggtaggttgcccatgctggtgtgcagtggtgcaatcatggctcactgcagccttgacctcctgggctcaagtgatcctcccgcctcagcctcctgagtaagtagctgggaccacagatgtacgtcatcatgcccagctaattttttgattttttttttttttttgtagagatgaggcctcactatgagcctaggatgatctcaaattcctggcctcaaacagtcctcccgcctcagcctgcccaagtgctgggattacaggcataagccaccatgcctggccttttcttcaaaaataacccttcaatcaattttttttttcctggtcaaattggattttgtgtttcttttatatattccttgtcaggccctacagttattttaattttgggtgttggatagactagggttcatattccatgcctgccatgctttttgtgaacttgggcaaaatagttagctcttctgagactcacttttgtcacctagtaaatgggttcagctgtagtactctatgtatttgtttgttttaagcattagatagtgcgtggtaaatgcttagcacagttcttagcacatagtaaatctttaataaatgttagaaaatataatgatcttgattctctgtcttccctccctagtagttgatttggggcacagtgtagcattatttgaattatcacagaataactttttacctttctgattttaacaggggagagtgtgtaaaggatgggagagggaagagagaaaaaagctgagtaaatgtgatcaactttacagtctttattccctgaactatctttccctgagttatgtgacacattctccttgttttcctctttctatctttgtggccactcctcagttccctaggcccctcttctttgaccactccttgtttgagttaccaaagattccatctctggccttcttgtgttgattctacacgttcttcctggaagcacatgtccatggtttcagcttccttgctaattaggagaaactttgtcctcagaacccatctggattacagccaacagcctactggtctccattgggctatctcccaggtacctataacagtctcagaactgactcatcttccttttcagcgtgttatttttataatctctatcttgatgaatggcacaacacagtgacccaaactggaaacttgaatgttgttcatctggttggtgatctgttcctaactgttttacatctgtaacatttctcaaatttgcctattttccaccatttctcctatcccttaattcaggctgcttctcacctagatgactgctgcaggttcccttgttgtctactcattattagtttctcattccaagtcattgattagatggctgccaaaagtgatctctttaacttcccaactttagattctgtgaataaaatccaaactccttaacagagcaggccctcatgatccaactcctcttaacgttggtagccttatcttttctctgagcccactgccgcttgatccttggtggtgctgtgctctttcttgctctctgtctttggttggactgcccacctccctccttcttacttgacattataatttatcagatagagatcagctcctccagtcagcatttccttactgactactccaagtctgacccagtgtagattctgtgcttatatctgtcaagtcacttattgtatgataattcatacacttatatgataattcacacattggcatgtgtagattaaacatttatagtctcagaaggatcctgatagtccaaaaggtatagtaatgcagttgtctcttagtatcttcaggtgattgattccaggatcccccccatggagatcaaaatccagggatactcaggtgccttatataaaatggcatatttgcatgtaacctatgcacatcctcctgtgtactttataggccctaaataatctccagattacctatatggctaaaacaatgcaaatactatgtaaatagctgttatactgtatttttaagtttgtttcttattttatggttttatttgtttatttttttgatctgtggatgtgcaacccacagatagagagggtcaactgggccgggcgcggtggctcacacccgtaatcccagcactttgggaggctggggtgggaggattgcctgaggttaggagctcgagaccagcctggccaatatggtgaaaccgtgtctctactaaaaatacaaaaattagccaggcatggtggcaggtgcctgtaatcctagctactctggaggctgaggcaggacaattgcttgaacctgggagttgaaggttgcagtgagccaagatcctgccatagcactccagcctgggcaacagaatgagactctgtctcaaaaaaaaaaaaaaaaaaaaagaagagagggccaactgtatgtaatttactgaagcatggattcacattatagatggtccctgatttatgatggttcaacttatgatttttatactatgatggtgggaaagctggtgtgatatacgtattcagtagaaattgtacttccaattttgaaatttgatcttttcccaggctagtgatatgcagtgtgacaatttctcatggtgctgggcagaagcattgacccacacctcccagtcagccatgtgatcaggagggtaaatgagtatactccatggtgtactgtgttgccaggtgattctgctcaactgtatgctaatgtgagtgttctgaacacatttaaggtaggctaggctaactatggcattcggtaggtaaagtgtgttaaatgcatttcctacttaaacgatattttcagtttatggtgggtatattggaatatagccccattgtagggcaaggagcatctttatttacccagttgagtttagtggcagcagaactaagttcggtttagctgttcagtgagccaagcctcacttagcatctaattctgtctttattttctgctttagataggccacagctctcctgaagggattaagactttctgtgtgaaaaatggtattcagaaggaagccagcattaattctgtttttatacatttatgaagatttgaaggaatttcactgtcaattctgtcttaattgtattctgtataataaatcataatggtatccaacggctcttgaaaggtttggtttttgtgaacatttctttgaatgtcaaagttgtattagtttgtttctcaattaaactgggtgctctttgagggcagggatttatgggacttgtttgttttgcagttttatatctccagctgctaatgcagtgcctggtttgtagtaggaatgagagatttactccaatagaaccatactaaagatcttacacttatggattacagttgatagctttgtagagtgaactggtattccctttaaatgagacgacatgacctgagtataaagtataatcaactacatgactccagcaagaataccatgtgtccctcagatagcatagctggcagatggagttatgcacatcaactggacatttaagacagctggagatttcttacatttagatgacagtttagattagaaatatttaatcttagctgtacttaatatattatgtagctatatgatacatcatgtatatatggtatatcatatatatcatatatttaatcacatttaatccttagctatattttcatccccaaaatggtatatggatctgtttttattgtcagctggttatttattgttgcttatccatggctcatgaaaatcttcatgttacttgggaaatctttcactctgccttttgaaggacagcccagaaccatttccttcttggcacatgaccttctaacccagtgaccaaagagtatgtaaaagcatggtacacactgcttttgaagattacgtgtgtctattctagatgtgtcttatttcttgcagatatattgcctacaaagattttgatatatatatatacagtagactatactatataattaatatttataccagatattaaatatataagcattctactagaactaaagttaagaatttgaaatagtctcatgtgagtaattaaaataacaatagcatctttttcaagaaagttttttttaatatggtggagataatgacatggaaaaaagtagttaattatttttggtattcccgtatttcatcagtaggttgccatagaacataatagttatataatcaaacagcagaataattttatatgaggtttattgatacagaaatgtttggttcagtgtttgtcttccagttttgcagattttcttttcgattttaaaactggagaatacattaaaaccagaaactttcagcctctataatgccctcaaaactcagcaggttttgaaaatgcctcttccttctcttctcctccccataatcctgcttatttttggcattaagtgagtcaggggttccaaacccaaatacgtttttcaaggctatgtagtcagtgtgaatgagagaagtaaatctgttgggtcctgtgccacactggagtttccaaggctggtctaaatgagttcaacttcagtttttttgtgtttttttagagatggagtcttgctgtgttgcttgagctggtcttgaactcccgggctcaagtgatcttccagccttggcctcccaaggtgctagaattataggcatgagccactgtgctggccaatttttttttttttagcccactgtgctaccagtttgtgatcttcactttaactgtgaaaggactgtcaaagattgtacgtataagatttagtttgagagccaggcctggtggctcatgcctgtaatcccagcactttgggaggctgaggcgggtggatcacgaggtcaggagatcaagaccatcttggctaacacggtgaaaccccgtctctactaaaaatacaaataaattggccaggcgtggtgacgggcgcctgtagtcccagctactcgggaggctgagacaggagaatggggtgaacccgggaggcggagcttgcagtgagcagagatcacgtcactgcactccagcctgggcgacagagcgagactccttcacccaaaaaaaaaaaaaaaaagtagtttgtctttctctttgaaactgaattcattaaacaaaagcctaaataactatactattacttgttatttatttatttatttattttagacagagtcttgatctgtcagcaggctggagtgcagtggtataatcttggctcactgcaacctctgcctcccaggttcaagtgattctcgtgcctcagcctcctgagtagttgggactacaggcatgcgtcaccacacccagctaatttttgtatttttggtagagatggggcttcaccatattggccaggctggtctagaactcctgacctcaagtgatccacccacctcagcctcccaaagtgcataagtgctgggattacaggtgtgagccaccacacccagcctactacatattcttttagacccagctgaaatatcacgtaattgctgaaggctcctgaactcttccagatcagggattgattttcctcattttaagattgtcatgacaactgtagtattgataactgtattttattttattttattttttttgagacagagtgttgctctgtcacccaggctggagtgcaatggcacgatcctggctcactgcaaacttagcctcctgcgttcaagcaattctcgtgcctcagcctcccaagtagctgggattacagatgtgcaccaccaaacacctggaattagtctggctaatttttgaagttttagtggagatggggtttccccatcttggccaggctgttctcgaactcctgcctcaagtgatccacctgccttggccttccaaagtgctgggattacaggtgtgagctaccgcacccggcttattaaccaatttttaatgttcagcacaacttgatcatgatgtacaatgtcttttttatgttatgtgttgatggagtcaaattaccgatattttggttcagttttttcaataagagatcaggctattttctgattttcattctgtttttttctttgatctgtatgtatttataagtgtctcttattttcaaataggttttttctagttatctttttgtaacggatttatagattatacattgtggttaaagaatatggtctataggctgggcacggtggctcacacctgtaatcccagcactttgggaggctgaggcagggggatcacttgaggtcatgagttcaagaccagcctggccaacatggtgaaaccctgtctctactaaaaatacaaaaaaaatttagccgggcatggtggtgggtgcctgtaatcccagctactagggaggctgaggcaggagaatcgcttgaacccgggaggtggaggttgcagtgagccgagatagtgccactgcaatccagcctgtgcaacagagggagactccgtctcaaaaacaaaaacaaaaaacaaacgaaaacacacacacgcaaagaatacggcctacatgcactttcagtcctttggaaattgttggtatttatttgccatttggcctagtttacccagattccacaggttgttaatgttgtacaattgcgtcttctctttctcacttcacccatctatgtaatttttctgaatcatttgagaaataagttgcaaacataatgctgtattacccataaatcagggtgtgtttcctgaaaacaaggatactctcctataaaatcaggaaataaatattgatataatactgccatctgattcacagaccctactcaaatttcactgatcttccaattatgtcttttatagcaaaaacaaaacaacagaaaccaacaaaattccctcaagaaaacaaaagcagaaaaacttccctttccccttcacttatttctgattcagggaccattcaggattatgccttgcgtttagttgtcatgtctgttcagtctcttttaatctagaatagttctcagtctttccttattttcagtgatcctaatatttttgaagagtagagaattattttgtagcaagtcccacaatttgggttagtctgatgtttccttttgaatagatttaggttatgcatttgtggcaggaataccaaagacacgatattatgttcttctcactgcatcgtatcaagaggttcatgtcaatttgtccaattactggttatgtttaattttaccacttggttaagatgttggctggcaagtttttgtaaaattagtttagaggtatttcatacttactggttagtaagtaataatgcattttgtggggtgatgctttgagactatataaatagcttatttctcatcaaatttttgcttgctagttttaccatccattggtgatttgtgcctgaatcagttattatagtggttgctagatggtaaatttaaaaaatttcattatttcttctgaattcatcacttggcatttctttttttttttttttttttttgagacggagtctcgctttgtcacccaggctggagtgcaatggcgtgatctcgtctcactgcaacctctgcctcccaggttcacgtgattctgccacctcaccctcccaagtagctggggttacaggcacccgccatcatgccctactaatttttgtatttttagttgagatggggtttcaccatgttggctaggctggtcttgaactcttgacctcagatgatctgcccaccttggcctcccaaagtgctgggatcacaggcttgagccaccgtgcccagccaatcacttgctatttcactctaaggaaaagctttctctctctggtttttgtctttgtttttgtttgtttaaaaatcttttaaacatatgagcacagcctcattgattcttattttgttcctttttcatgtattttttgatattcaaattgtcccaaatttggccagtgggaaccctttcaggctggctcctgtgtcctttttccatgtcctcatcattctttttttttttttttttttttttgagacagagttttgctcttgttgcccaggctggggtgcaatggcgtgctctttgttcactgcaacctccacctcccaggttcaagcgatcctcctgcctcagccacccaagtagctgggattgtaggcacctgccaccacacctggctaatttttctatttttgtttttattttttttattttttgagacggagtcttgctccgtcgcccaggctggagtgcagtggcgcgatctcggctcactgcaagctccgcctctcgggttcacgccattctcctgtctcagcctccaggcatgcgccaccatgcccggctaatttttttgtatttttagtagagacggggtttcactgtgttagccaggatggtctcgatctcctgaccttgtgatccgcccacctcggcctcccaaagtgctgggattacaggcgtgagccaccgcgcctggcaatttttctatttttagtggagacaggatttcaccatgttggtcaggctggtctcgaactcctgacctcaggtgatccgcccgccttggcttcccaaagtgctgagattataggcatgagccaccacgcctggtcatgtccccatcattctttgatcactttttttcttactttttggaataataagattttctgtgggctgggcgaggtggctcacgcctataatcctagcactctgggaggccgaggctggtgggtcacctgaggtctggagttcgagaccagcctggccaacatagtgaaaccttgtctctactaaaaatataaaaattagccgggcatagtggcacacacctgtagtcccagctgctagggaggctgaggcaggagaattgcttgaacccgggaggcggaggttgcagtgagctgagattgcgccactgcactccagcctggatgacagggcgagactccgtctcaaaaaaaaaaaatttctgggctcatctttacttttgttatctcagtcgtggaatcaataattttatcagggaaccctggttccttttattagtgaatgtacttagaaaataaaatatgtgcactactagatatgttctttctattggggtgttcttccttttaggctctatgtgaggagagaactagaatattgttttaaaatgtaccaggtaatcccagcactttggtaggctgaggcaggcaaggctggcagatcacttgagatcaggagttcgagaccagcttggccaacatgatgaaaccccatctctaccaaaaaacacaaaaagtagccaggcgtggtgacacgcacctatagtcctagctagagtgagatagagtgagaccctgacttaaaaaaataaacaaataaataaaatatactggaatttaatttataggtatgaatgacacagagaggccaatattattgaaaatgtgttactcacagttcttctgaaacagcaggcgcaccatactatgcaggaccacatggggaagcaccagggtgggtcaggaggcagaaggaaccagaggaaaggatgggtgagttttttttttgttaaagtgctagaaagttgttaggtgggacatcccctattgagcagaaagagaaacacaaatgttgagatttgtggttggacggtttgtaatatgatttttgtgtagcctcaaaaacacagagatggtatgaatgtaaacaactttggtcgttaatttggcccatcctttcaagatgccaaatcatcaattacagaatatcaagaatgattatataggtatgtatgcatgtctatacatacatatatacatctgtatcttcctgtaaataatgaaagccatggtttcattccaatactcttaattctagtccaacacaatagggtttcttctggtgtttcccttttctgacattgaaaaatctgaggccaggcacagtggctcttgcctgtaatcccagcactttgggaggccaaggcaggtagatcacttaaggtcagttgctcgagaccagcctggccaacatgatgaaaccccatctctactaaaagtacaaaagttagccaggtgttgtagtagtggtcgcctgtaatctcagctactcgggaggctgaggcaggagaatcgtttgaacccaggaggtgggggctgcagtgagctgagatagcgccactgcactctagcctgggcgacagagtgagactccatctcaaaaacaaaacaaaacaaaacgaaaaatctgcctcctttttttttttcattcattcattaattctttagatggggtcttgccctgtcacccaggcggtagcgcagtgacacgattatagctcactgttgcctcaagccatcctctcgcctcagactcctgagtatctgggaccatacaggcacgtgccactgtgcttggctctcacattgtcctttttactcaccttcctgttggtgacaatctcctgactatgtaggccattttcttgcccccagccccactgaatgagctggctgatcactccttcaagttccatgagccattgttacatacaggtagtactcagtttgcttggttttgatattcataaatttccattgctgtggtttaattaaataatgccagtcctcaaatagcagttaatgaaatacaaaatataacctgtgatcaagaaaagcttctcaggtgggcgtggtggctcatgcctgtaatcccagcactttgggaggccggggcgggtggatcacctgaggtcaggagttcgagaccagcctgaccaacatggtgaaaccccatctctactaaaaatacaaaaaattagctgggcgtggtggcaggtgcctgtaatcccagctactttggaggctgaggcaggagaattgcttgaactcaggaggcataggttgcagtgacccaagatcaagccattgcactccagcctgagcaacaagagcgaaactccatctcaaaaaaaaaaaaaaatagcttctccaaaattttaaaaatttaccctgaccctgaaatagttgattgttccctccctagacatcattcagttggagctagcctaattttgttttttttgttttgttttgttttgagatggagtcttgctctgttgcccaggctagagtgcagtggcgcgatctcggctcactgtgacctctgcctcctggttcaagtgattctcctgcctcagcctccagagtagctgggattacaggcgcgcgacaccacacctcgctaatttttgtatttttggtagagacagggtttcaccatcttggccagactggcctcgaactcctgaccttgtgatccacctgcttcggcctcccaaattgctgggattacaggcatgagccaccgcacccagcctttttttttcccttgaggagaattacagtctgcactgctctcagctgaactttacacagcttttacatttccctctgtcagttcctcttgtaatggtgggtgggtagctgaagggaggatatgtacaataatgtatttttagttcctttgaacagagaggttgcttcagccattgctattgatggcaggaagtatatttatagctccagggaaggaggggtagtacgactgctggtttaagaaaacctgggagattgtatttaatatatgttgttaaaactcatttgtactttattgtaagttcttgccttagaaatgcagctgagatgaatgaacctgttacttatgttatattgttacttatgttatatatgttatatgtattattgtaagtatattgactctgctccctaatttggaaaaatcttccgttttgaaattttacaatatacaatacctaaaacaaagagtacttctagagcatacaggatgtatgtggagaattcaggtgttagcatgcaattgaacagtaaagatactgactagcagtataaatatcgtccccatttagatattttattcataaagttcttgttggtgtagcttttattgtgattttttcttttttttttttggatacagagtctcgctctgtcacccaggctagagtgcagtggcgcagtcttagctcactgcaacctctgcctcccaggttcaagtgattctcctgcctcagcctcccgagaacctgggactacaggtgagcattaccacactggctaatttttatatttttagtagagatggggtttcaccatgttggtcaggctggtctcgagctcctgacctcaggtgatgcacttccctcggcctcccaaagtgcagggattacaggtgtgagccactgcgcctggccaattgtgatttttttaaagattgaaaccaaaatattttatacagatcataagatattcttggtaaacactaagcacctcataactttaccacaattttgattgcacaactttcacctgtggttatcatgtgcaatgggcacattcaacacaaatcaaattattctgaagcttgctttctttcttttttccctactccctttcttaattgaggggagcaaaaagttggtttccagggatatgtcttctctcttatgctggtcccagattgatgcagtcatggaaactaggcagtaaactcattcttggcagctgccggcactggtctgattctttcttttaaaagcatgagattctttaataacacatattggaaagattgatgccaagtgattccaggtcatcctagaggaggcttgggaacattgttgaatagatttaaatgattcagttaagtgagtgatttaacccaaggtttgtgtctaatttaaacaggacctataaaatatagaacaattggtttgtttcttttttagaatattgaagattagattttaatttgagaattttactaatttgagggttttattttttgtttttaagcgttcaaaatgttgaattgtagatatgctgagttttataatgagcacaatgaaggtttttcaactggcccgttaaagccaacccactaatgaaatgaaaatatgaaatattatgactccataatatttcatggattttgaagctgggctgcctgggttcaaatcccatctctgctactttttgggtacgtaaccttgtgccagttacttaacctctctgtgcctcagtttcttcatctgcaaaatgggagatagtgcagtttgagtgttcctaatctgaaatctgaaatgctccaaaatctgaaactttttgaatgcctacatgactgctcaaaggaaatgcttattccatggagcatttggatttcggatttttgggttaagaatgctcaattggtaagtaagtgtaatgcaaatattccaacatctttaaaaacctgaaatccaaaccacgtctggttccaagcattttggataagggatactcaacctgtaaataatgtctgtttcatggggttgtgatgtggagtaagtgagcaaagttgtgtaatgtgcctagcttatagggaacacttagcaaatgttggctattccatttatatataagaaatagaattattggctgggtgtagtggctgatgcctgtaatcatagtgctttgggaggctaaggtgggggattgcttaaggctaggagttcaagaccagcctgggcaacatagcaagactctgactctgcaaaaaaattcacaaattagttgggcgcggtggttatatgcctgtagcccttgctactcaggaggctgaagcaggaggatcgcttgagcccaggaatttgaggctgtggtgagccatgataatgccactacactccagcttgggcaatagagtgagaccccaacttaaaaaaaagaaagaattattgatgggattgtaaaggctgaatattaaataaattcagaggaggtttttacggaacttatttgtgaaatatttttaaaggaaggaaggcatgtttgttttaggtttataagagatggcagatttaggaagctcctccctactccagatgaataagccatctgtttttctatcccttttaaggatttgcttggtgggtttccataacttttttttttttgagactggatcttttacccacccaggctggcgggcagtggcgcaatcatggctcactgcaacttcaatctcctgggctccagcagtcctcccgcctcagtctctcttgagtagctaggaccacagacgcgtgccaccatgcccagccaatttttatttatttttttgtgtgtgtggagatagggtctttctatgatgccccggctggtcttgaactcctgggctcaagtgatcttgctttggccttataaagtgctgggattacagttatgagccatggcgcccagtctatgtattcttacaaaattaaattcatgttaagtgctacactagcagaatttttaaaatttttaaatgatgcacaaatagagaagagagagtgcaaattaacgagaaataggcaagactaatttgaagaaaactatgaagctttactgaaggatttttttaaagatataaaatgctggccaggcgcggtggctcatgcctataatcccagcactttgggaggccgaggtgggcggatcgtgaggtcaggagatcgagaccatcctggccaacatggtgaaactccgtctctactaaaatacaaaaaattagccgggcatggtagcggatgcctgcggtcccagctactcgggaggctgagctggaagaatcacttgaacccaggaggcagagttgcagtgagccgagatcacaccactgcattctagcctggctagagagcaagactccgtctcaaaaaaaaaaaaaaaaaaagaataggcaaataactagagaaaaatagtccagaaacagacctgaatatatataggaatttagaatatgaaagtgtcagtgtgtaggaaggagtgaaatgaaaaaagaaagaaaaaaggaatatgttgaaagtggcattcagaaatcagggagaaaatgatcgattactaagaatgatcctgtaacagtgggctgtttggggaaaaatacgtaaagatttctaatttagactatattcaaataatcaccaaattatatagagcagggatacccaacctccaggccacagaccatcctgttaggaactgggccacacagcaggatatgaactttaggccagggaacattacacctgagctctgcctcctgtcagatcagcagcagcattagattttcataggagcacaaaccctactgcgaactgtacactccagggatctaggttgtgtgctccttatgagaatctaatgcctgatgatctgaggtgttgcagcttcatcccaaaatctgaaaccatatcctccacccctccatttcatagaaaaattgtcttccacaaaactggtccctgggtgccaaaaagattggagaccgctgataatagagtatatataatcaaattacagaaataaccacactctattcttcctctagaatatactgaatgtttcctaagaaaagttgaacactcatggctggttggctgctctctagcacatcttgccttcgtctctcactagttgaattttacacttccaggggtcagtatgtttgttccaaatctgcttatgccagttacatttagtactgtaattttataatttaattaaacattaactaatgaaatatgactgcaaaaagtagttgtttttaggaaaattaagttgtagatcttgaacaaattggataaatacaaatccccttttccccttttcaccaaattactgtcttactaattgtgggcgtgaatattttgaaagattgggggtggaaatcataaaattcttttttttttttttttttttttttgctcttgtttcccaggctagagtgcaatggtgtggtctcagctcaccacaacctctgcctcctgggttcaaatgattctcctgtctcagcctgccgaatagctgggattacaggcatgcgccaccacacctggctacttttttgtatttttagtagagacatagtttctccatgttggtcaggctggtctcgaactcctgacctcaggtgatccacccgcctcggcctcccaaagtgctggtattacaggtgtgagccaccacacctgacctcgtaaaattcttaaacgatctatactcagttgtcttacagttgcctagattcttgttccatttaaagaaactgaaatttgaaatcacaaatgtggattatggatatgatgggttatggatatgatatatttgtaatgaatatgcaagagagaacatttgaaacattaattagtagaaatgtacttaaagaagaggccttggttttttaccgtaatattggcaggtgacatgtatttgttttgagtaaaaatcaaatatttcagttacatttttaaaattacctgatatactgtactttttcatgtaaccagtcagccctgagtcctatttgtgttagataagtttttaccaatcccagaaggagatagaggacaagcttttatatgcttcggctgaagaaaacctttctccaaagaagtaattatctgatcctcctataaagggccagatagtaaatattttagattttgcaggctgaagtagaatcaagggtaatacgtacgttctgatataacaagagagaaaacaaattttgagaaatttcttaattgattaaattcaaaataataaacacaatttattgaaatacaggtatactaatgagaagaatggagttcttttcggagtgataacattttcttaattggagttcagagttagtgcttcctattcaataaataatcatcaaaattgattgcaagtatttatctattaatgcaggtctgtaatgaggttttatatatttcatctttgacatgtcttcacacatacatgtcaaataattgataccagcccataaacatatgattttaattgagcatattaataactcaggaagcatttatagaattaggtttttcttataacatttaccttttagtatattattcattgctgcttaattacttccaatggaaggttagacagaagctccacaattgcactgttaaatagatactgaaatatagatatttccttgtgcattaaggtcctaaaaattattctggaaatgtagtgtgagctaagaaactatatccactgcaaatttgtttgggaatggagatctcacttcttgttttaacttttgatagcatgtaaagtgtataaagcagctcaacgttgcttatgattcaaaagttagttgtctaaataacaacagtttaagtttcatatataagtgttgttctgtcctgtaattttaagttgaatttactattataaaattagcaaaagctaattctcaaagccatttattgtttgatcatagtgtctgaaagcagtcttattgttgtgaaaaatttcaatctcagttccaagctgaaaagaaaaaaaaaaaagcatgataaaactttagtacagctcagccgtcaaactgctgtgtgcctgggcaagtcaggttattcagcttctgtttctgacaatggttaagcccatggcagtgaatgaaattcaccattaacatggttggtttaataattcatgataaattcagatatttttcatagaatatctattgataaaaaacatgaataaccaccttacattttcacgttttataaatcacccaactaagcctttttctgcttcacacatatttttaccattatcaatgataacgtatctgagattccactttaggttatatggaattagtactttttcaccttcttgtttgtagttgttcaacacagactattcatagaagctaattcttcagttgttttaaacttggcactgactccttgaataaacatctgaacagtgttgtaacatctatcaaactcattcaaaagagatggaaatctacttaacctcaattgccttggttttttttttaaacagattattgatcttgctcctaatattttcgacttttagagcaaatgattttgttgaaaggctaatagtctttttttctttttaaattatcttatattaaatttaaaaaataatttttttgttacctgtctggagaaagcctagagaaaggctaattaatactcttaaacaagtttattttctctggatacatttcttcagcttcttcatgatttaattcacttatcactagaatattacttttcttgctttgctaacaaatgagctacttagaaacttccctcctttacaaactttctattccttaccttccctccttgctgtaatgaaatattccactttaaattttcaaatttttctgaccattgctttcctgtgaatcggaaatactgtgatcggtccttagtttggtaacattgatgtattttgaattcttttagcacagacagacagttgactccttgaacaacgcagtttcaaactgcacaggtccaattatatgagaattttttttcaataaatacaatcagcagtttatacatatacaaccaaacgtggatcaaaaatacgttatttgaggaaacccccagatacagaacagtgaaatttttgtatcctctgggccactgtgggacttgagtgtgcatagattttggtatccacggttgatccacagataccaagggatgaccgtagagtcattgcataataaacaaaatgcttccctatcttgtcttgataaaataatgcataccctccactgtgccttaaaagcatgacattcaggctgggtgtggtggctcacacttgtaatcccagcacttttggaggccagggtgggaggattgcttgagcccaggagttcaagaccagccttggcaacatagtgagagtccatctctagttttaaaaaaatacaaaattaaaaaaaatgaaaaacatgacattcaaagtgcatttgtttttgtttcgacatgatggttatgcactaataactaatgatagttatgtactaataaaatgtcaaaataataacgacttttagttactgataacagttatgcattaataaaaaataaaatgtcacagtatgacaatatgcatgtgtggcaccaaacatgctgttgagttataactttgtgactgtgatttgtgggatactgagcagcagtggaaagctatataagccactccactctgccagtcagtacagtggctgattaccaattatggataaccagaacacatcaaaaagcagttcaacaaggatcagaataataacatgtaagtaccatttattaagtagttatgtgtaaggcactgtgtcagactgtataatgtacattatttaaccttcaaaagattgagagggaagatcccttgagtctgggaggtcgaggttgcagttagctgtgattgcaccactgcactctagcctgagtgatggagcgaaatcctgtctcaaaaaacaaaacaaaacaaaacaggcctggtgcggtggctcatgcttgtaaatcccagcactttgggaggctgaggctgaggtcaggagtttgagaccagctgggccaacatggcgaaaccacgtctctactaaaaatacagaaattagttggtgtggtggctcacacctataatcccagctactcgggaggctgaggcaggagaattgcttcaacccaggaggcggaggttgcagtgagccaagatcatgccactgcactccagcctggatgagagtgagactccatctccaaaaaaaaccaaaacaaaacaaacgaaaactacaaaagattgtctgaagccagccacagacaatagtaaatgaatgagtgcagctacattctttcttatttatggatgcagaagtttgaatttcatataatttttccgtttcacttatatataaattatatattatatattacataatatataatatatattataagataatataatatatattagataatatatataatataagataatatatattagataatatatataatataagataatatatattatataatataattaaaatatattaattataatatataatatatgacatatatatgttatatattgttatatataatatgtgtaattatatattataatatatgatatatatataatctatcatatatcatatatataatctatcatatatcatatataatctatcatatatcatatcatatataatatatatcatatcatatataatatatatgatgtatagtatatatgatatataacatatatataatatatgatgtatagtatatatgatatataacatcatatatactatacgtcatatataatatgacgtatagtatatatgatatatgatatatatactatattgtatatgatatataatatgtattgtatattatatataatatatatataaggcacagtggagggtatgcattatatataatatgtattatatattttatatattataatatatattttatatataatatattttgtatattatatattttatatataatatattttgtatattatatattttatatataatatattttgtatattatataatatataaaatgtatattatatataagtaaagtatatattatatataatttttatatatactttttttttttttttttttttagactggatcttgctctgtcacccaggctggaatggagtggctgggactacaggtgtgtgctatcatgcccagctagttttttttttgttttttttttgttttttttaattttttttttttttttaagacggagtctcgctgtcacccaggctggagtgcagtgacatgatctcggctcactgcaagctccgcctcccgggttcacaccattctcctgcctcagcctcccaagtagctgggactacaggcacccaccacacgtccagctaattttttgtatttttagtagagacggggtttcactgtgttagccaggatggtctcgatctccggacctcatgatccacctgccttggcctcccaaagtgctgggatcacaggtgtgagccaccgcacccggcctactttttattttaacttttttttttttttttgtagagatgtggtctcactgtgttgcccaggctggtctcaatctcctggggtcaaacagtgctcctgcctcggcttcccaaaatgttggtattacaggtatgagccactttgcctggctatcttataaataattttgatgttaggaatttttagttgcttttatttttatttttgttgttttaaatatttattaatagaagcaaggggtggataaatcttctagatcaaactcttccttaaaatagttctgcttttggtaggattccagattttcctagttttgttaagtgtttctaatgatgtttggcataggtgttaacttcatgggcctgttgtatacaaaccaatttttttcttgctctgagtgaacagtaacagaacctggtaggtgagtcacactgatactgcattcactgaagttactaagctgaatgataagagatgagaatcctttgcatttgtattcaaatcaagagttgtagaatttgaaattcctgttttgatgaactatgtgaagcatgctgtcattcttctctgctagtctatgttgatgatgtcattaaactagtctttgacttttagttcttggcttaaaatattggaatgattatataataaataggtttatttcatgtggaaaaggaataatgtgtttgccctgaaatagtctgatctgatcaggaggatattatgctgagcatggctggaaataaatttgtagcaccaattaaatacactgtagcagctctgagagggaataaaagtaaaatataaatagtaaatatgagagaaagtgactatgggatctaactatgtaagagcagggtgggagtatgggtagatacgtacatgccccctagattttaggaaagcatatttcaagaagtagagaagacatggatatcaatcagtggaaatcgtatactaaaacggaagtcagtgaaaaaaaaagactgctctcaaactaaagatagatggttgcttctaataggtaggtattcagattcgattaagaaattagaaggccgggcatggggactcaggcctataatcccagtactttgggaggtcatggtgggcagatcacttgagcccaggagttcgagacaagcctgggcaacctggtgaaaccccatctccacaaaaaataccaaaattaattagcagggtgtagaggcacatgtctgtattcccagctactcaggaggctgaagtgagagaatcacttgagcctgggaggttgaggctacagtgagccgagatcacaccattgcactccagcctgggtgacagagtaagaccctatctcaaaaaacaaattttgaaaatatacagaagtatagaaaaactgaagtaatttaatttgtgttaaaatctgtttggtattaaaactaatgtttggccgggcatggtggctcacgcctattaattatcctagcactttgggaggccgaggcaagtggattgcttgagctcaggagttcaagaccagcctgggcaacgtggcgaaactccgtctctacaaaaaatacaaaaattagctgggcatggtggctcacgcccgtagtcccagctcctttgcaggctgaggcaggaggatcacttaagtccaggaggtggaggttgaagtgagctgagatcgcacctctgcactccagcctgggtgacagagtgagaccctgtctcaaaaacagacaacgacaaaaaaccctaatgttttatgaaaaagctctttaatttttcgtgaccaaactgctattctctagacctacactgtccaaaatgatagccattagccatgtgtgctactgtgttggacagcacgtatttagaacatttccaacatcacaaaagttctattgcagaatgctatgaaaatgagatacactttcattagaaaagctagtaaaaataagtaggggtaatggggtactttgactatccagaaattttactaaggaagaattagatttttataatactgggacattagtgtgcactttttttgtcgtaattgcattttgttttttattttgaaataaatacatgtacagaaaaattgcaagaatagttacagagtcttttcgctccctgaaccattagagagtgagccccatcagccccaaatactttaatgagcattaaatctggagtttggccgggcacggtggctcacgcctgtaatcccagcactttaggatgacgaggtgggcagatcatttgaggtcaggagtttgagaccagcttggccaacatgatgaaaacctgtctccactaaaaatacaaaaaaatgagccgagcttggtggtgcacacctgtaatcccagctactcaggaggctgaggcatgagaatcacttgaacctaggaggcggaggttgcagtgagctgagattgtgtcactgcattccagcctgggtgacagagtgagaccctgtctccaaaaataaaataaaataaatctggagtttaataccagtacagtactaccagcttatcttcaggccccattcgagttattctagttgtccccaaaaggtgaaggatccagtttaaaatcacacattgcatttagttgtcatgtctgtctttgacttgatcgccttgacacttttgaagattacaggctcattattttgaggaagtcattaacatggacctgatgtttcttcatctttagattcagattatgcattttatcagaattgccacataaattgtgctgtgttcttattttatccatccaggtactacataatttccatgtgtcccatttttcttgatgttaaccttggtcacttgattaagattgtgtctgccagttttctctaccatacatttaactattttttcctttataatcagtattttatgaggaggaggaggaggtactttgagacaatgtaagtatcccattcctcatcaaactttcaccttctagttttagcacccattgaaatttttttgctggattattggtatgatggctgccaaatgatgattttctaatttcatcatcccttctacatccattcattgacatttcattgaaaggaaaaactgttttcttcccatttatttaacttatatcaatatggacttacggattcatattttattcaataagttatctattagtgtactttggtactttgatgctgagtttgtcccagatttggtcagtggaaaccctgtcaagctggcttctgtatccttttgacattgtcctatcattctttgatcactttcctctttctgggaccagatatgatcaaagcccttcttatacttttcctgccctacctctggaatcatttcaccaaggtaccctggttccctttattgaagaatgtatttagaggttaggtctggacagtagatggcattgttccactgaggtgtcactgctcctagactttctcagcagacagagctagagcatatatgcatgtatatacatacacaaacatacatccacacacatagactcatttttttatttcttgctctgtgtgtgtgtgtgtgtgtgtgtgtgtgtgtgtgtactgtgagttcacactggtacctagtacctcaacacctcagagttcattttatttttcttcctttttgtatttgtaactcccttctctgacagagaaactgggccccagtttttcttaatatattactatttacttaattgatcaatccccttgaatgtgcccagtctttcctttccttatcagatcatgtgcatgctaaccttgctcagccccacctaatggtttttagactgaattatttggagacgaaaaaagtacggttgatgctcattagtcacagattttttttatttgcaaattcacctacttgctaaaatttatgtgtaaccccaaaatctgtactcgtagcacttttatggtcattcatgaacacgtacagaagggtaaaacatttgagtcgctattgggtaacgtgtattcctaggtgaggccaagcaaggcagtctactgccttcttctttgagtcctcatactataaatagttgtcccttttgcagtttacttagcgccacatattttgcattttgacttcttttacttagcatgtgttttcaagttccatccatgtttatagcatgtatcagtacttcattcttcttcttttttttttttaaagagttgggggtctcactgtgttgcaggctggaatacagtggctattcacataggccatcatagcatgctgtagcctcaaactttcactgggctcaagtaatcctcccacctcagcctcccaagtagctgagattagaggtgtgggccactgtaccaggttccttcctttctaaggctgaataatagttcattgtatgtataataccacattttgtttatctattcatccaataatgggcatttaggttatttccaccatttggctatcttttgaaaatcttttcatgtgcttgttggccattagtatatattctttggagaaatgtctcttaaattctttgcctattttttaaattggggggaagttgtctttttttgttactgaattgtaagagttctttattctgataactagacccttatcagatacatgatatctgattaacacatagtttcttgcatcccataggttgtctttcaaaattttgacgaattccaatttgtcagttttgttgcttatgatttttagtgtcatatctaagaatccattttcaaattcagtgtcatgaagatttacctatgttttcttctaagaattttatagttttagaccaagcgcggtggctcatgcctgtaatcctagcactttgagaggctgagacaggcggattgcctgagctcaggatttcaagatcagcctcagcaagatggtgcccatctctactcaaatacaaaaaattagcctatggcgtgtgcctgttcagctactcgggaagttgaggcaggaaaattacttgaaccatggaggcagaggttgcagtgagccgagattgcatcactgcactccagcctgggccacagagcgaaactatgtttccaaaaaaataataacaataattttatagttgtagctttttaagtttttaatccactttgatttttttgttttgttttgttttttgagacagggtcttgctctgtgctgcaggctggagtgcagtagagcagtcttggctcactgcagccttgacctcctgggctcaagctatcctcccacctcagcctcccaagtagttgggatcacaggcttgtgccaccatgcctggctaatttttgtattttttctagagatggggtttcactattattgcctaggctggtcttaaactcctgggctcaagtaatccatgcccaccttggcgtcccaaagtgctgggattacaggcgtgagccaccactttcagtcccaagttaatttttatatatggtatgaggtaaggattcattcttttgcatgtgaatatccagttgtcccagtgccatttgttgaagagcctgttctttccccattgaatgttgtcttagcactctttccaaaaattagttgaccatagggcatggtggctcatgcttataatccaagagctttggaaggcccagatgaaaagattacttaaggccagtatttcatcaccagccagccatggtggtgtgtgcttctgggagggtgaggcagaaagatggcttgagctcgggtgttgaaggctgcagtgagctctgattgtgccactgcactccagcctgggtgacagagtgagacactgtctctaaaaaatagaataataaaaatcagttgactatagatttgtggatttatttctgaactcatttaaaactattccattgatctatatatcactccttataccattaccacacagctttggttaccggtgctttgcaataagttttgaaatcaggaagtatgagttctccaactttgttcttccttttcaagattgttttggccattcggagtcccttgcaattccatataaattttaggatcagtttttttatttcttttttttttttttttgagacagagtctccctctattgcccaggctggagtgcagtggcgtggtcttggctcactgcaacctccatctcccaggttcaagcaattctcctgcctcagcctcccgagtagctgggattacaggcacacaccatccgcccaactaaattttgtatttttagtagagatggggtttcagcatgttggccaggctggtctcgaactcctgacccccaagtgatccgccggcctcggcctcccaaagtgctgggattacagacatgaaagcttttttatttttgaaaaaataaataaataaataaagacataagatgtctttccatttatttagggtctccttgttcttggaggtagattttctctgatctattttcattgagaccttgggccttaagagagccacaatttcatgagagattatttctctggagcccttcctacccttctcctatttcctgtctcctttcctcccttgttattcaaaagtcttaacaaatgctcctgggcccaatacagaggtcagctcacacttccagccttagctttggttcactttttgctttcttgccactggtagttttccctcctctcttaagaacttagctaagcttttcaaaggatgtttgcatttatccaacatttctagattttggtagctggagagttttaataattttctagattgctgttttactagattagaaaaagatagagctgggtgtagtggcacatgcctgtaatcccagctactccagaggctgaagtgggaggattgcttgagcctgggagttagaccaacctgggcaacatagtgagacctatctcaaaaaaaaaagtaagactttagggcgcagtgtaatcccagcacttttggagaccgaggcgggtggatctcgaggtcaggagttcaagacaagcctggccaagattgtgaaaccccgtttctactaaaaatacaaaacttagctgggcagagtggcaggcgcctgtaatcccagctactctggaggctgaagaagagaatcacttgaacccgggtggcagaggtttcagtgagccgagattgcaccactgcactccagcctgggcgatagagtgagactctgtctcaaaaaaaaaaaaaaaaaaaaagacagtgttttttaaagatggagtttagtatacagaaatattgggtgtcaggcaaagtattaattactttgtacgtattctcttttccttcttttttttaaaacgagacagggtgaccaggctaaactctgactgttgggctcaagtgatcctgccttagcctctggagtagctgggcattacaggcacatgccactgtgcccggctacatactcacttataaaactctatttttaaatgacagctcctctttacaaaatagatcaggagagcgattttcctgtctgcttcctgaggaagcaaaaaggcagaaacatggtgagcagcaagaccagtggttgccgtagtaagcatgggacttcctatgaatggctctgttaacagtaggggatggtaatgttctttgatttgtggactctgtttgatttgtggacaaggttttatttcctgtctttggggtaggagggtctgccatatccacaaattggctcttcccatttgttgtattcatttagttagaccatgattggaaagcctcactggctgtgcacattgcaccatacttaggaatatatgacggttatacatttcaaacagggctttaaaaccttccattcagctccttttggataaagctcttttcctcatgtggttgttgacatacatgaattataggctttgtttagctagtgggtaagagcagattttggagtcatgtacacctgggtttgagtttcagtcttgccatgtaccagttgtttgtggacaagttatttattaataactactctgtaccatagtttcttcattggtagtatcttcaaaatgaagtatctatttcctgtgctgttttgaaggtaaccttaaataatgtgcattgtacaatttgatacagtgtctgacacgtagtaaatactttaatatataatacctgtttttattctgatccttgttgagctgctgctttttgatgtgttgattatatataattggtaatcatccattttactgacatcttccaagatttgaccaagttgattgtctcaaatttccaagcagaaaaagtacccagaaaacagaaattaagcagttattaaagaatcgaatagcaatgatcattacgacttgtgcttaataagaaatgtgggccatgtctgcctgagcctttatttaatgcattttaaaatttgctgggttttttcctccctttaaaccttactatcaggttcagtaataagttaaactaaaaagaaacggatgccttagaataaagaaagattcaaattaataggatatataatggcctttcatggtggtggaatttctgtgtgttttgaactaagggaaagacttaaaggaagattgcctacagtgtactggacactttgctaggctctgtggatattatcaagacacagtccttaccctcaaggatctttttatttttcttttagagacgggatcttgccctgccacccaggctggagtgcagtagcaaaatcatagttcactgcaacctccactcactctcaaggatcttactctcagctgggggaggccataaacagttaaagtagcttactctcagctgggggaggccataaacagttaaagagttaatgattgactctagggctaagggaaagaaagtaattgggtcaactaggatttctagcttggcaagggggtagacctggattggcaaactacaacccaatgccagtttttgcatagcccacaaactacaaatgtttcttacatctttgagtggttggaaaaatatcaaaagaagaatactattttgtaacgtggaaattatataaaattaacatttacatgttcataaataaggttttattagaatatagctatgctgaaactacatatctatgactgcttttttgtcacaacagcagagatgagtaattgtgacaaaggctgtttggcctgcagagccaaacatttactgtgtggctctttacagaaaaagtttgctaactcaatgagtaggtggtaatttttatccattgaaacaagcaattaaggaagaacagatacaggagaagataacatttctgtgagtgttgattatttgaatcagaggtacttgtgaatatgcaggtctagaaggcaagggaatttataggtttggagtttggaaagagcttgaggctggaaatggatgtgggaggaaaggaggagatcaagaagactggatggaggagtgcaatttttagccctgtctgcacattggaatcacctgtagtgcttaaaaccaaacaaaaccagacagacatttccaggaacccaaccccaactccctctttcccaagattatgatgcacctgagctggacttgggcaccagaattttttgaaagctcccccagcaactctaatgtgcagccactggtacagagtgagaagattggaagatgggacaccaggaacaccaacatttaagggatagttctaggtgcttctgctgaggagaggaaattctgagggagtgatgatgggaattttagggtggtcagatcctgtaatttgagatcattgttgactgatgaatcaagagcagtttctgtagaggccaggtgagggtgtatgtcagaggcccctggtttgaggtgggagagtatgaactattgagaatattgaccgggaggaaaggggggaaagtgatggctgggatggggggcattgggaatgtagtttgttctagagaggtttttttaagatgttaaagccttgaggctatttatgtgctgagggagtgagtactcagaaagaaagcctggaatggcagtatcagatgccaccattcagttttcatgatggagtgaagggctagattttgaatagttcttggaataatcttaatattgtaacctttttggaactgtttgcttaatgtgctttcttcatttaggtgcattacattgtacctggaaagagaaatggacccaggcattgagaagcaaggccaacaactctgctttgcttgcccggttactgtcgttctgtctgggacattggtctcatctctgaaagcaggagggcaaactgaatgggctctgtagtctcttctaaaagtttttagtttaaactattaatagtacaactttgatttaacaaatgaggaagctgagcttacgagatgtctgtgaagcccattgtctgatcttttatttccttagtacctgggaatgcgcttttttttttttttttttttgaagaacaccaacagttgttcacccttccttgaatttgggtacactgtatatacagagtataccaatttagcctgccattagaacatgtcttcacgagcaaaatctagtataaagtcttactttaatattttctttattatgtataaataatagatggttgttatggaatactggatagtacaaaagtttagaatttttaacattttggtttatttattgggactcttttttccccccagtgattcttgtttctccaacaatgtgaatgcgcactccattcagtgtgaacgtgaatgttaatttatgtgccagctggattctacaggaagcagacacagatggggttggaggggcaaagggcttattagaggagtaatgcctgtgaagaaaaggggaacggaacatgtttgggtatagggagccatcagactgcagtgcacacctgacgaagtctctgcccacccagattgcctgatagaggaataccacaagaggtagaaatggctaggctcttgtactaccactttgcacagtcattgactagagatagatctttgatcaatgtagagattttcagccttggcattgttgacatttgggactggatactttgttatagggggttgtcctgtgatttgtaagatgcttagcagcatcctaggcctctatcccctagatgccagtagcccagcctccctgctattagttgtgacagtcaaaactatctttagacactgccatatgttccctagggaagggcctaatggtatataaacaaccctatggtggcatagtccaagttttgggacagggaggagtgttctatactacccttactggaaagacctatgagctattcagaaatctgaactatttaagatggagctttgttctgtggctcctggaattttaagcacacccctgtgaaacatcttgttaggatatactccactctccaaaacaatccataatgtttaaatagggctgttttattgattgattgattgattgattgagatggagtctcactctgttgcccaggctggagtacactgtcacgatctcggctcactgcaacctccccctcctgggttcaagcaattctcctgcctcagcctcccaagtaactgggattacagacacccaccaccgtgcctggctaatttttgtatttttggtagagacggggtttcaccatgttggccaggctggtctcgaactcctgacttctcaggtgatccgcctgcctcggcctcccaaagtgctgggattataggcatgagccaccgcacctggccttatttttctttttgagatggagtctgactttgtcgcctgagctggagtgcagtggcgcgatctgggctcactgcagcctctgcctcccgggttcaagcaattctacctcagcctcctgaacagctgagattagagatgcgtgccaccatgcccagctaatttttgtatttttagtagatgcaggatttcagcatgttggctaggctggtctcaaactcctgacctcaagtgatccacccacctcggcctcccaaagtgctgggattacaggcatgagccaccgctcctggctattttcttttgagactgggtctcattctgttcccaggctggagtgcagtggcacaatctcagctcactggaaactccaccttctgggctcaagcagtcctcccacctcagcctgctaagtagctgggattataggcatgtgccaccctgcctggctactttttgtggagatgggattttgcatgttgcctaggctgggcttgaattcctaagctagaacaatctgctcagggatgttgtatatttctaaaggtatttttccttttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 947 - DNA, 174476 bp, Homo sapiens
ccacgctcaggggagcaggtaccccttctcctaaagatgaagaggagcaaactggcactaagcaaggccatcgagagcggggacactgacctgggtgagggcaaggctggggggcccctgggctaagtgggagcctggctggaattcccactccaccttactctcctgcagtgttcacggtgttgctgcacctgaagaacgagctgaaccgaggagattttttcatgacccttcggaatcagcccatggccctcagtttgtaccgacaggtgtgtgtagtgggcagggttgtggtgtagccttctgagcacttgagttggccttgctgactgattgcctgcctgtggccccagttctgtaagcatcaggagctagagacgctgaaggacctttacaatcaggatgacaatcaccaggaattgggcagcttccacatccgagccagctatgctgcagaagaggtctgagatccatggggcgtgtggggcgtgtggggcatgtgggctggggctgttggtccggttccttcaggaatctaggccttcgtgttgggtgcacactccatctggtcctcactgtgagggagactctgacgtgaggccaggatgggggttagtgtcagaggagctagccatccctctaggacatcagagtggtgcacctagcaggcaaggctgaccctggcgaccctgggcacagggatgggggagaagactgtagcctgggtgaggagggcgagggtcctgcatgctgtgagttcaggccttccttcttgtctttatagcgtattgaggggcgagtagcagctctgcagacagccgccgatgccttctacaaggccaagaatgagtttgcagccaaggtttggcccacctttttccaagagcctcctcgtctcctggtcttccctcctggtccctcatccccatcatgcctcattatccgggtccccaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtaggtgagggcccaggctgcatgtgggtcccaggaccacctgcctctcctgcaacacctccaagcccagctttcctgcaggctctggtggctgaagctgactgccctggcagatttggaagattgggaagagctagagaagttttccaagagcaagaaatcacccattggctacctggtgaggcagggtcctccctccagcccacttccagtgagggtagtcttcgggagagagggctaggcagggagacagataggatggcccgttcatgctcctgttcagctgcccgcatagttagcgagtgcttcctgtatacacatttgtgggcaggcatcatctgctgtgttgggtgcactggaggatgggtccaagtttgcctgcagatgttacggggagagagaatgagctgctttccccagggagggccacagggggcactatgtgctagagggaaagtcttgtctgaggagggtggagggggcacagggagggtgcatatgggaggcagtggagatactgagggctgttttctgtggtgggtagttcagaggtgtatagggcaggtttgagaatgtcaatcacaagagaacacaggaaatgtgagggctggtggcaggaacgcctgttgcaaggggtaatggtgggtggtagagcagaagcgtggaaataattggtctcaagtctctgacagagctttggtttaggtgatttctgccctaagaatgttgagatcacaactgtctgtgcatgggggttgggggattatatgtactgacgggtgtatacatatagaatatatatggacgatgtatgcattgcgcctctgctcgtaagagagaggacaggagggctgtgcattaccttctccctccacccgcttcctctcctccaagccttttgtggagatctgcatgaaacaacataacaaatacgaagccaagaagtatgcttcccgcgtgggtcccgagcagaaggtcaaggctttgcttcttgttgggtgcgtcaactgagggcctgtgggtgctgggtggctgagctgtgggctggtgagaggcagggtttgtgcccttgagcagccccaacaccacctcctctcttgctcaaaccacagcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttcacagtgcttgtcttacacagtccagcctaagcaaaggcaagctcaagacaggatcctccagacaccacagcaaaactccatgtgttccgttgtgttgggaccggaggtgggggcttctccagccatactcgcaagaaacgtgtcctctccacagttaccaaggaaagctttctctatctcacagctcctaggaagattatagggagagatggcacaaaacttaagcaccagctcaccaagaacatactgtaaagcattctgtgtgtgtgcgtgtaaacacgcaagaaccacgctaaacacttttgctgcctgtacttcctttattcctcgtgacagccctgtgaggtaacatcaccccactttacagaaaggagattgaggaccagggagttcgataataacaaatatgtggcaaaacagggatttgaaaccccgggccaagtgcaagctggaactggaatcgggccctctgtgagaagggagcctgaggcaaggccccaatttgcactgcagtggtgattggaggactaatgagaagtgtgtggcctgcgggccataggggtcagggggtggtggcctttggaactcttgcccactgaactgtggtgagcaattccaagttgtctctgggccaaatagagaaggaggatggaagatttcaattctgccaaaaagaaccatgaacaccagacccgcaatcagtaggagtacccgcggggccctctgctctctctatctagccttccgttggcactccagtgcaccccctctgctctccctgtctagccctccgttggcactccagtgcaccccctctgctctccctgtctagccctccgttggcactccagtgcaccccctctgctctccctatctagccttcccttggcactccagtgcaccttggcttcatgcccagggccccacccaacactgagggcattgccttttcctttgtcgcccccactttgtctacaaggaggaaaccacagccagagggagtgcaggcctcactggagcttcaggcctctccctatttaacacccctagggccgaccatgcttttagaaagacagtgagagactcagggcctgagaaggtatttctttttttccttttcctacctgacttgtaaatgaaagtttgtgaaagtccttcaaggagatataagtcaaatggtaaaataactatcatgctcgccattcattatgtgggtcaagaatttggacaggttgtaacagggatggtttgtgtctgtttcatagtgtctgaggcatcagctggaagactaaaaggttgatagctaggggctgaaatcatgtgaaagcttgctaactcacacacttggtgagtgacgctggttcttcactgggaccttagctggggtggtctgccagaacacctgcaacatggtggctgggtcccaaggacaagcatcccaagagggtgccaggtagaatctggactgccttcctaacctagatttggaagttacgtggtgtcacatctgctagagtatttgtcacagcagtaatacaggcccaccccaccaatttcaaggggaaatagactccacctcttttttttttttttttttttgcgtggtagagatggggtctcgggggtctccttatgttgcccaagctggttttaaactcctgagctcaagcagtcctccctcctcagcatctcaaagtgctggggttacagcatgaaccactgaacctggcctggactccacctcctgatagggagtagcaaagttctggaaatactgtggctaggttttggaatcacaatctggcacagcccatcagctttcccttttggaatcagcagacaagaggaaaggaaataatccccaatgctgggctcatcattctgggcttttttttttttttttttttttttttttttgtccccagtcttggccccacaattcctcactgccctggtagctctttgatgcctttaaaaaatgttttcccagcttttcgagttctcaatgaaaaaggattgctatcaaacaacccagttttcctctctggaaagggaggcttgaccagtgcttttagaatgtacacaatacaaaacccacatctccaaagtaacatacagtatatttactcataggctatgtaaacaaacactgtacatatgaagttttagaaatatgtgagaaataacttttaactgatgacaaatgtatatcaacagtgatttcaactttataaaaggtgtgtgtgcatgtagagaagcattggaattgtctatggggagagttgctttaaaaaggcagttttgtatacttttttgtaaagttaatcactgatttgccccccacctccacagtttattataaaaactttcaaacatacagccaggtagaaataattttacagtgaacatttgtgtaactaccactggattctaccattagcatcttactatatcacacatctgttcatctatccattcctctatgtcaatccatcgtatttttcatatatttcaaagtaagttgcagacatcagtacacctccccctaaatacttcagtatgcatttcaataactagagttcatttttggtttgcaattttttttttcttttcaggcaaaatctacatacattgcaatccacagatcttaaatgtaattttctaagttttgacagatgtataagcctatgaattgtgacatttaaaaaccagaactgggattttcttttttcaaatccttgcttactcaattgaaattagtgtgagatgccttctgccctgagcagtttgtacagcaggcctatgcctacatgggtgggcagggccaagtttcgtccaatgtatgacgctaggattggggctaggaactaggactgtgtagctggaggcaaagaatctgggaacatttcttcttgtatcagtggtagccagtgcagggagaatcagggcaaaggctgggcgcagtggctcatgcctgtaattccagcactttgggaggcttaggtgggtggatcacctggggtcaggagtttgagaccagcctggccaacatggtgaaaccctgtctctagtaaaaatacaaaaaaattagctgggggtggtggcgggtcctgtaatcccagctacttgggaggctgaggcaggagaatcgcttgattgcttgaacccaggaggtggaggttgcagtgagctgaaatggcgccattgcactccagcctgggcaatgagtgaaactctgtcttaaaaatatatatatatatatcgagcaaaggctcctacaactcaccttctcagggtaaggggctgtatgtccagtctcttagatacaaagttccagtgaaagactcttggggttggccaggcgcagtggttcacccctgtaatcccagcattttgggaggctgaggcaggcagatcgcctgaggtcaggagttcaagaccagcctggccaacatggtgaaaccctgtctctactaaaaatacaaaattagccaggcgtggtggcgcatgcctgtaatcccagctactcgggaggctgaggcaggagaatcgcttgaacccgggaggcagaggttgcagtgagccgagatcgtgccattgcactcaagcctgggcaacaagagcaaaaactccgtctcaaaaaaaagaaaaaaaaaactcgggtttgaacagtgtggcctgcaaagggacttggctctcatttacttcacctttctatcttattgccttgctttattttcatttcagcatttaggaaattttcttgttcttttgtttattgtctgtgttcctatccagaatgtaagctcctgagagcagaggcctcttctgtcctcttctgtcttattccctgctgtgtccagcacatggtctgcactcaataagtatttgttgcgagaatgactcattgttccatttactagaaggggaaaggaggccccgagaggggaaatgacttgcctaaagaaacaggagtcctttccccccatcctccagctctcctgatcctctcctttgctcataaaccctgtgactgttggggcacctgtggggtggctgcgaaatgcctacctgtaggtatgtgctcctgtgggttgggactaatgcaggactaggagtaggagggctctgcagtcccccatttgggtaggcttgggcacaggaaactgcctcctttcccttcctcagttctcttctcttccaggataaccctttactctgtgatgatgatgggcgagggagctcaggacactctgggagccaagtaggatggagggctgggcaggtctctacaggcaggcagctgaggagggggctctgtcttcttccaatggaaacagcatctgtgtggttgctgagctgaaccctccttcccagggtctccagggtctgtagttctccttggtctgtagttctgtcacccctgtgcacaccccacaaatgctttgaccatagtgcagctgtctcatggggagagaaagaactttcatttcctgagaatgggttacttgccaagctgaacatgcctaattctcaatacagccctgggaagttccaggaagagttgcagagggaggctcaggtcacccagcacatggtggggctggaaaccccgggctctttgactaccacgcccaacaacaatttttccaagtgtggtcatatccaaaaggggtccttcagataatctcaaagatgaacacttactgcaatcactatttcagttatattaaaaatataagtagcatgtcaaccccttctagggtaatacaaataaaaagtaaaaaaaaactaatcaacaaaaagaaacatattaagaaataatagtgtaaattagatataaggcaaaagtaagctggtggggtttggttctagagcatagggctgctatcccagctactgaggtacctcctgcgtttgcagtcattacttgttaggggttttcacactttgacttcctgcttttcacttttccattcggtgttgcgggatagattgagtttggacttaaggggatatgtgaatgttgggcgtggggaaggatccaccctcactggggtctgagcgttaggagagtaggcgtgtggactctgggcctttgggctggagtgtctattggtcagaggtgtcgggttcggccatttcaccctcacctctaggctggccctgctgagagggagagagagtcacaactcccactcaaggagagacttccctgctggggaggggacggcctgaggcccgccccacccatattcccaggccctggctctggttagcatggactaacttattccacaatacggaggagtggggcacagagtccctaactggcgccccaacagaaggcggtggtggggaccggagatggtaggactggagatggtaggggctgctgatgtgagcccacaatacggaggagtggggcacagagtccctaactggcgccccaacagaaggcggtggtggggaccggagatggtaggactggagatggtgggggctgctgggagccccttttgcgccgcagtgtttcctgccatgaagagttgccgccggtcacaacccttccccgggggcgccccgaatgtgggactccttccggcctggggtgcgtgagggggactcaggggttgcccggtctggaggagagactcgccgccacctaccccgggaaccgcagactctgggtctgggataaagcgtcccctacccgcaagctcggtttgtgcgctactgtgcaatctgtcttttgcctgcagacgcccagccgctcgccctgcgcgggtctcggaatgtccaggggtccctactggggatcacaacccggcgaaatgtcgcatttgccaccacctatctcgactgcgtaatcggctttcagccgcagacgctcaggtcctgcagcacccgcggggatccgtgtaggaacctgctgccgctggatggactgagcgattgcttcgcgggtgtcacgcaccagacgccgtgccgggagcgccgggaagggggtacgcgccccaaccccggccgggggagggcgcactctggctcctctctgcgttttgagcctcccctcccccgccaggcgtatcgcaaaaggcacctccatcgcagagcaccatgtgttgtgcttctactcagctcggtggcgagcggggccccagcatgcgcatctggaaagcgggggagattaccctggagctcgggtggggacggcgtgggctgacttgatataagacgacacccacggagccagatccgttctagggacttggcaggttcctctccctccccagtgagatccgtcgttctttgcagcaattaggggagggaaaaaaaagacccacagtatcacgtttggagagggttaggaagatggctctcgagttgcaggccgccctggtggctagacattggtgtagtttgtgcctggcctcggtttcctgatctgtaaactgggaagaaggcccaagtcatgaggcctgtgactgtagaatggctgaaggcactggtgcactcgcagccggtccttccggggtccagcttcccgaaggactgggcagccccggggcgaacccctctggagctaccaggagaacgtgcgaccgggttcggcgccccagccggcaagtgagcgcccagcggagcgcaagggcggggcccgcgcgggccggagacgcccgttcgctgtcggccaaccagcgcctgtctctgaacagccaatgaacacgcgtcttacagccaaggccgggtcgggagcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagattaaaaaaaaaaaatagcagagcagagtcctgtcttgagggtttcgtttttatttttgagatcactgatgatatttgtaagacaggaaaagaagaatgtgcaaatccaccctctgcagggtgaacgccatcagaagcctttgctcaggagagggattccggctctagaaccagtccacatcaccctggagatggcttcgtttgccacctgctagctgtgcaggcagcctgagaaacagaagatggtgggcgagaggaggactgactaggaaagggcgaacatcttcctgcctggccactcctttcagaaacagatctgatgctgtcacttgtttacttaaaaactccctcgcttttctttttcccatgggatgaatgaagcctaaaatgccttatcaggtcatacaaagcccttgacaatcttgcctcaatttactcctttacttttagcctaatcggatcctccaattctccttcccctcatcccgcttgctggctagtattcagagctgcttgactgccccctcacatgttgggatgtttttgttttatgtgatcctctttcttccccacctttacctgccaagctccactttttcttttaaagttcttctcatttgagaagcttcttgcgggcaggagctgtgtcttgcccacctttctatctcccgtggtgggagaatcctccaagttgtcttgtagattctttccaatctcttctctcttatgcctaggctctgtttatttcccggtatccacttcccaagagattttttcgtgttttgaaggcctgcttggagtacatgcccaggacttttagtatttctgattcccggcttccccatgtccatcccacccagcccccataagcagtcagcaggtgggaactggtaggtcccatatcccactggcctccaaaaaactgtctctgaaagactaaaagcccttcagtctcttttcacctctgcctgctcaaagtgacctggctgataccgtgcattgtaaggcatggtgggatcccggggcctgttctctgtttagccacttaacatctgggtgaaatacagaaccagaaaaaccacccctctgacttcagtacattcatgtgtcttccctttgccaggtgaattgcttgggatacaaaagtgaggaagtcagtccttaacctttgaggaactcagagtctaatgtaggacaggtggatataaatacatcacaggtgctataagattgtgataataataatagctattttttatttgccttgtgacaagctatgtaatgttttccatgaattccctcagtcttttcaacagtcataaaagggcttattcctactctacagggttggaaactgaggccaaacagtgggcaaatgagggaatagtcaagatttgaattttggccgtgtatttgcagagcctctgccaggctgtgtagggagcatcccctgcctgggtgatttgggaaagctttcctgggacgggggggccttcggatcatgaaggatgcataggagtttgcgcgtggtggactgcacacataggcaagagggagcagcacaagcaaacttggtggtggaaggaatccactgtccttggggaggagggaagaggttaatcatagctggatcaggtaaggacaatggagagctactagaggatttaaaggaggtcagggacttgggctgaaagaattttggaaagatcatttgggggcaatatagggccaaatgcagatgcccctgcaatataggaggcactggttgggtctgacagaggtagagtcacagcctcttagacccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtttccaggttcttctcttacagcaatgaatgtccttgtacatactgtgttatgtgctcatttgcaaagttatctgaacaatatgcttttagaagtagaattactgggtcaagggatatgtctgcatttttgatttgcagacatggagccaaactgccacccgtttctggggggttgtaccaatttatcctctcccccaaagtgtatagctggatagatgatctttggagaattcaggaggatcaactacgatgctttttcagctattatatgcctacttttcctccacaaatcctcccccaccctatgcgattctagccagtttctttgaatttacagagggagatgttgaggctcagaaggataaaagtaacttgtgcaggatgatcagtgcgggtggtggtgggtgttttgttttgtatttttgcacccctcatgtttgtatttgccagcacctttcattggaggtgctcagtgtcagtttgtaaacattattgcattatttttctccattttcacatggaaaaaaatgagatgcaggggaagtttgagttatgagagggaaactggccaaatatagaatcttgtcattttacttccagtgcaataataaatgtttccaaatgacaaagctgaagagatgttttttgtttgtttgtttgtttgtttgttttttgagatggagttttgctcttgttgcccaggctggaatgcaatggcgctatcttggctcacgcaacttttgcctcctgggttcaagcgattctcctgcctcagcctcccgagtagctgggattacaggcatgtgtcactgtacctggctaattttgtatttttagtaaagacggggtttctccatgttggtaaggctggtcttgaactcctgacctcaggtgatccgctggtcttggcctcccaaagtcctgggattacaagcatgagccaccgtgcccggtgaagaaatggttttttagtgagtctgagtacaacaaaaatagcaataatataacactaacttaataaaactgaacagcaggcccaaaaatagcccaacattaaaatttattttaatgtattctctatggaaaagagaatccattaaatgtaaaactatttattttactctaaattcacatccatttgtgtcagtgtacaagacataatttttatagtagcagtcagtacatatagaatatgatttttgaattcttcaatagcataaaatattttatatttactcatttaagtatttgttcatttaaaatcacaggctgggtgcggtggctcacgcctgtaatcccagcactttgggaggctgaggcaggtggatcatgaggtcaagagatcaagaccatcctggccaacatggtgaaaccccatctctactaaaaatacaaaaattagctgggtgtggtggcgcgtgcctgtaatcccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcgacagctgtagttttttttaaatttgtttttgtttttttgagacagggtctcactctgccaccctggctggagtgcagtggcatgatcacagctcactgcagccttgacctcctgggctaaatgatcttcccatctcagccacctgaatagctgggactgcacaggtctgtgccaccacgaccagctaatttttttattttttgtagagacatttttatgttgcccaggctagtcttgaactcctggactcaagtgatccacccgccttggcctcccaaagtgctgggattacaggtgtgagccaccactctcagccaacagctgtagttggtgcaatcctttttattcttttatttttttctacctttttgctattataaatggtacttttataccccttgttcaaatacttcttttggattatttccttggactcttactcccaacctgggctcaccaagtcagaggatacagtttcggtgcctaattgcaatctggaaaggttgaactagtttccagcactatcagcaatttatggggccatttcttgacaacccatctagtgctattacaaagaaatgtaatgataccttgaattaggtttaatttacattgctttggaaaaagagaccagtagctgatttagattttttgaaagaagtacagtgctgtgatatagattatctccaagatttatgtaactgaagccaacttgtggttgaagaaagatttggttgatgagattgaaatattgtggaagtttagaataggatcatagcagtataaaatataaggctagatgctgttcagttggaaataccaggcattgtgccggaagctggggacaccccagagtaacatagatgtgatgtctgtcctcatgacacttttaggttagtgcagtagacagacattaaaatcacctatggtaattatagatgtgatgaaaggggaagaatagggtgtcgggagtgtcagagaagttcagcagctaaacaacatttgcagttaaacatttgtgaaggccctgagctgagaagggatttggtagctcagggcagcgcttcgctaacttgaatgtgctcatgaaccatctgggaatcttgttaaaatgccaagtcctgaatcagtaggtttggggtgggacttgggattctgtgttactaaccagctcctgggtgaggcagatgctgctggtgggtggatcacacttggtgtagcaaggcctaattgagagcttggtgagcacctaaaactggctgaccatggtgagcaggaaggggcaggtggcttgcagtgacagagtaattctctgcctaggctgcactttagattcacctggggaacttagaaaaatcagggttgcaaatgccccacccgcagccattttaatttaattggtctcagttggggcctgagaatgtgtatacagtcatgcacagtataacgatgtttccatcaaggagagactgcatatgccacagtggtcccataagattataatccataattttactataccttttctatttttagatatgtttaaatacacaaatactcactgtgttagttacttacagtattcagtacagtaacatgctgtacaggtttgtagcctaggagcagtaggctatacaatatagcctagatacgtagcaagctgtaccatctcattttgtgtaagtaccttttatgatgtttgcagaattatgaaatcacatcaggactcatcctcagaatgtgttccattgttaagtgatgcatacctgtatatatattttaactccccaggtgattctaatgtgtagccaggcttgagaactagagactaaggacagtgttgagactagagaatggcaaggagcagagttgagggtcctgtatggcatgcaaggattttggactctatcctgaaggcagagctaaatctttgaaggatttttaagcaggagagtgaactgatctgatttgcaattgttaaaaagttcactgtggctgtagtccagagcagtagttttcaaattgaggtagataagatgatccaggggaactggaagaaaatttagaactttttattgtttttatctaaaagataagataaaacatttaatttaggaattgtctctggcatcttcttgggtctataggtcaaacagttaatgtgttaactgtagaactttgggtgtcctgaaggaagagactgaattctgcagtgagcagagacatatttatacatttgttctccatgtattgcaacatgttgttaacagtttatattaaccagttctcattgaactagcctttacaaaatggacatgcagagaaaccagtgatcaaagaaaatactaataatacaagcacaagcaaacaagttgtcagagctgacacttgtccaactcctgtgatgaattcttggtgagctattcaaataagtcagctcttactaaattggaaagtatcaggaaatttataagaaacatgaactttcgtgctctgtcattaataggaatcttgctttaagattccttttaatcgtatgtagaacccagctgcacggtggctcacacccataatcccactgttttgggagcctgaggtgcaggaggccaggagctcaagacaaacctgggcaacatagcgagaccccatctctaccaaaaataaaaaattagccgtgtggtgtcacgtgcctgtagtcccacttacttgggaggctgaggcagaggattgcttgaacccaggagttcaaggctgcattgagccatgattgcaccactgtactccagcctgggggacagagggagactctgtgtctcaaaaaaaaaaagaggaggaccgggcatagtgggtcacacctgtaatcccagcactttgggaggtcagggtgggtggatcacaaggtcaagagatcgagaccatcctggccaacacagtgaaaccccatctctactaaaaatacaagaattcgccgggcgtggtggcgtgtgcctctgggtaatttcagctactcgggaggctgaggcaggagaatcctctgagcccaggaggcggagtttgcagtgagccgagatctcgccactgcactcaagcctgggtgacagagcaagactctgtctccaaaaaaaaaaaagtatgtaaaaccttgagatattaaataataaaatatgaggctgtcaccagtatgaagacatttgaaaaccaaaaatttggaacataaaaagaacctctacattttttttgcagtgatgtttaaagataaaggatattccatcagatgctttacaaaattttgctaacttcaattattaaaatttatattttgagggttttttgcttttaagagacagggtctcactctgttgcccaggctggagtacagtggcacaatgatagctcactgcagcattgaactcctgggctcaagcgatcttcccaccttggccttccaaagctctgggactacacatgtgaaccaccatgcctggccagtttttaagtttattgttcttataaaagacaaaatggggccgggtgcagtggctcatgcatgtaatcccagcactttgggaggccgaagtggacggatcacttgaggtcaggagtttgaaaccagcctggccaacatggcaaaaccctgtctctactaaaaacacagaaattagccaggtatggtgggcacacctgtagtcccagctactcgggaggctgaggcaggagaatcgcttgaacctgggaggcggagattgcagtgagctgaggttgcgccgctgtactccagcctgggagacagagcgagactgtttcaggggaaaaaaagaaaaaagacaaaaaaacacatacccttggcagattcttcctgccccacccccaaaaggcccacttaaacaaaaaatggactgatgtactacatggaaaataattttgtcaggaaatcaaaatactgttggaagatgtatagaaaacattgctgaatatgtgaacaaacaatattagaacaaattttgcagtgtgggaagtttggtatacggttataaaagtacagaagcttctagcatgtctcagtatcgctagatactcttttttttcttttctttctttctttctttttttttttttgagacagttttgttctgtcacccaggctggagtgcagtggcaccatcatggttcactgcagcattgacctcccagtctcaagtgatcatcctacctcagcctctcaagtagccaggaccacaggcatgcaccaccatacctattttttttattttttatttttaggagagatgaggtctcactatgtttcccaggctggccttgaactcctggctcaagcaatccacctgccaaaagaccttccaaagtgctgggattacaggcatgagccaccgtgccaactgtgccaggcctagattaccttttaatagttacatccaagaataaggaccacttcttttgtgagctactggaagaaagttgtactggagaagacatatttttaatagtaaatgattgccttcataagaacattactatatggaataatagactgaatgtaaattaatggaacagctgctttgactgaacaaaagaatgaaattcattcattacttctctatgggcaggctgttgagtccacttatttgttaattatcttgtggtagagttgttgatgagttttgcatttttcttttttaaaaaaatgccaactttttgttatggtaagtggctacagtttgagtaatcctaatatgaaatccaaaaggcttccaaatccaacactttttttttttttttttttttttgagacaggttctcactctgtatgtagcccaggctggagcgcagtggcatgatcatggctcattgcagccttgacctcctgggctcgggtgatcctcccacctcagcctcctgagtagctgggactacaggcatgcaccaccatgcccagctaattttgcaaccagtaggaataatgcaaatagtacaaaatctgaaaaatacctaaatctgaaacacttctggtcccaagcatttcagataaggaatactcaacctgaacctagcaaatatcatttgaaaaaataatatcttaatctgtctcttcaagtaaaagtattatttaaatagtgagtgaaaaaggaactacttcttttcttagaaagaaatgtgcaggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagaaagaaatgtgcaatggtagagcgttttcctcgttggaattttttttacatgtaatcattataagctataacttacatattataaaattctcctttttaaaatgtacagttctgtggttttttgtatatgcatagagttgtgcagcttttgccactgtctagtttaagaacatttcatcaccccaaaagagaccctgcacccattagcctcacttcccattctctcctccctccagtccctggcaactactaatcttcctgtttctttggatttgcctattctggacatttcatataaatgaaatcatacaatatgtgaccttttgtagctggcttcttttacttagcataatgtttctggggttcattcatgttgtatcatgtatcagtacttcattccttcttatggctgaataataatccattatattgatatacgacatttggctaactggttcatcaattgatgaacatttatttgtttctactttttggctttatgaataatgctgctgtgaacattcatgtataaatttttgtgtagtcataggttttaatttctcttgggtatatatatatacctaggagtaggattgctgggttaaacggtgactaactttgaggggctgtcaaactgttttgtaaagtgactacccattcccagtagcaactcacaaaggttccagcagcaatacaataggggtccagtttctcccagcaatgcttaggggtcccaatgtctcccatctttgccaacatttgttactctctttttgattatagccatcttagtgggtgtgaagttgtatctcattgtggtttttatttgcatttccatgatgatttatgatgtgcatcttttcatgtgctgttggccgtttatgtatgttctttggggaaatgtctgttcagatacttggctcattttaaaatttagttattgctctttttattattaagttacttatatatttttagatataagtcccatatcagatatacgatctgtaaatattttttcccatctgtgggttgtgtgttcagctgtttgcgtggacatatccttttgggtagatctaggagtggaactgctgagtcaaatggtaactctctggttttttttgttttttttgtttttttttttttttgagacggagtctcgctctgtcgcccaggctggagtgcagtgacacgattttggctcactgcaagctctgcctcccaggttcatgccattctcctgcctcagcctcccgagtagctgggactacaggcgccccccaccacatccagctaattttttgtatttttagtagagatgggatttcacagtgttagccaggatggtctcgacctcgtgatccgcccgcctcggcctcccaaagtgctgggattacaggcacaagccactgcgcccggtttgaggaaccactgactttgttgaggaacagaaagaacgcctgcacctttttacaatcccagcagcagtgtatgagtgtatcagtttctccatatccttgtcaacacttgttgttttttttaactgtagccatcctagtaggtgtaaagtggtattgcattatgttttaatttgcatttccttaatgactcatgatctgactgtgattttgttgcatctataaaattctcataatttgacacatgaaaaccttagaaacaattttgtaacctaataaaaatctccaaatgtgtttctaaaaacatttccagatgatctaatgaagtaaagaatctaggcattggtcaccagtggctgttaaaaccattagggaactttataataaagggatcagtgtgacaatcttctgatcaatcataacatctctaaaattgggacaaccaaatcttatattctttctatgtgatactaggaagaacatatcattcatgaaatagtcttgcttgccccaacaaacagagtcaaaccttcctctgattagtgtagatctgattactggtttataggatataattggcaaatttagaatgtgaaaaatattataggacaaatgaacccatttacttcaaatgaatggcaagaaaaaaaaagtacacgaactgctacagattaaaaaagacttgaggctgggcgtggtggcccacgcctgtaatcccagcactttgggaggccaaggtgggtggatcatgaggtcaggagttcgagaacagcctgaccaacatggtgaaaccccgtctctactaaaaatacaaaaattagctgggcgtggtggcacgcacctataatcccagctactcgggaggctgaggcaggagaattgcttgaacccaggaggcggaggttgcagtgagatcatgccaccacactccagtgtgggcgacagagcaagactctgtcttggaaaaaataaaaaagacttgaatgaaacatattaattgaacataagtatagatcttgtttagatcctgtttcatgcaaaccaactgtaaaaagttatttatgagcccattgggagtaatttaaatttgaaaaccacttgtatattagatgatttttaaacaattttaattttttaaaggttattatagtagtatggttacattaaaaagaaagactcctttctcttacagataggtactgaagtattttggatgaaatgatgttgatatctggaatttgctttaaaataattcagcatgtttggaggattacagacgagacaagaattgccatacgttgataattattgaagctggataataggtatataagggtttattatagtattttctctactgttgtatatgtttgagaattcccatagtaaaaaattaaaagagaaaccactgtaagggaagagttttagtggatttcatgtccatttgttagaaatagaaaaatgtggccaggcacggtgactcacacctgtaatcccagcactttgggaggccgaggcgggcggatcacctgaggttgggagttcgagaccagcctgaccaacatggagaaacccccgtctctactaaaaaaaaaaaaaaaatacaaaattagcctggcatggtggtgcatacctgtaatcccagctactcgggaggctgaggcaggagacttgctttaacctgggaggtggaggttgccctgagccgagatcgcaccattgtactccagcctgggcaacaagagtgaaactctgtctcaaaaaaaaaaaaggaaaagaaaaaaaagaaaaagaaataaaaaaatgtagtatctttgattaattttcaaaagtatatcacagaagatagatatttgctagccatatttaaaaggaaatatttgtataatgggggtgaaaaaatgattatcacagtttagtaaacacagccatagtgcttcttcctttggattcatgtttctttttggttatgatagcattaaaacttggaatcaggcttttaaattgctctataatatattaaaatgagatttttcaaacataatgagaaatatttaatcatatggattgcactaaaatatttttaagatgggttttacattactattttaattgatggaagtaccattattgtgatcattatgtatttcatttgaaatgttttgtagtatttataggtattagtacctgtgttctgtttataaatgaacatgtgttggggatgtatactcttatttattggtggatgtgcagtaaaaggtttgtttgtggagaacggactgggcagggtatagagacttatttgatgtttattagagcaaatgtggccagtgatgatggtgttctggattggcttagggtgggaggagtggtgatagggatggagatacatggacaagtatgatttaagcagtagaggcattagggttctagatttctggctttttggaagagatgattgctagttaatgaactgagcttttgtgtgtgggaagaagttgaaacctggcccctgtgaattgtgcaagtagttcttaaatattgattgacaaatagcttaacgagcaactaattttcaaatattggttgacaagtggcttattacaatattgtaaatgcattgatactaccattagtaaagagaatgtcttcctttgataatgttagcagcactgttaccagagcagtgtgggatagttccaggactttcactgtctaaaaggaactggaggcccaagcttttacggggatacttctgctctcctggttcccatgtccccagtgatgtgaatgtccctgactcagtgcctctgctcacgctgtctgtgagatcactgccttccagtgcctcttacctcttgggcctgcccactttgttaacagggacagatttcacagtgatttccagccagtatttctctctccccagtttggggtgttagctagaatggtccctcaaagccctcaaacacggatgagaaatagaagaagctcagggagactatacctgggctaggttcttgctaccagctggtggaagacaaagaaaaccccttttcttcctgtatttcatgcccagtgagcagtagtgccatcagcagcagttgtgaacccctaaatcagtgattctcaatatgactgacatggtggggaagacgtaagtttgaaaatgcattttcaggctaggtgtggtggctcacacctgtaatcctagcactttcggaggccaacatgggaggatcacttgagcccaggagttcgagaccagcctgggcaacatagtgagaccctgcttctacagaaaaataaaagctagccaggtgtaatggcatgcacccatagtcctagctacttgggaggctgaggtgggaggattgcttaagcccaggagatcaaggctgcagtgaacataccacagcactccagcctgggcagcagagtgagacccctgtctcaaaaagaaaaagcatttaaaaaaaaaaaaggtttgttagtgtttgtctcaaaattttgcttaatttaaaattatgtatatatttgaataatatgtgtccatgttaatagttctaaaagtatatatagtatatatagtaaaaggtagttttctctccccctgcctttcagctttccctttccataggcatccacaagtactatgagcaatacttgtgaaaccatgctgaaatactacatgctcataaaatgtaagttacttaagtttggtatttcaagtaacaataagggaagataggagagttttatgtttatcaaaaggggtgaatgttatagcagattgagatgagatgttcttacctttgggtgggatcttaagtggagctcaattcggtttccccaatgttagtgggagagattacttaaaccatccatacttatccagttgtacttggtaagttttcaaaggttctactttgaagagggcttttgttgagcaagtagtggttaatagagcagctcagttacatgtgtaagttttttgatgtgggaaaagggcttttgtatacagaaggactattttaaaattatttgggctttaaattaacatgtattaaagtggtaaatttaaaacccagttttcttttagtcttgttattgtacttgtaagcataggcattttgtatagaaataagaatagtaattttcacctgcttgtcaattaagttaatataaatttaacagatttaattgctccaggccccttacttagtgaattaaatttccttagatgtttaaaatacatttacacagtcagtctgtcaggcacagtcagtccttgacaggtcagagttaccaccttaaacagaaacttcttaagctcttgggcaatctgtgatactaagaaattaaatttgtaaatgtagtaaaacaggttttggttaagacttccagtgcttttcattagctgaatctgaattaccaacatttaaaaaacacataccctaaacttaacgcaaaagtactactagtaccatgagtttgatataccatacctcattttattgctcatgtcttttctttctgggattgtgatgccacttacccaattaaggaggacagttttatcatctcagaaagccatggttatcagattaaaaatacagaatcatgatacagttattattggtcagagatttgagactgggaaagggaactaaggggtctgtgtttccaggataattctactcaagagatgctgtgcctttccttatgttaagagtcctgaatgtggcatcaaagggggaatccatgttcagagtttgttttgcaaccccccatacctttttttgagacaggatcttggtaggttgcccatgctggtgtgcagtggtgcaatcatggctcactgcagccttgacctcctgggctcaagtgatcctcccgcctcagcctcctgagtaagtagctgggaccacagatgtacgtcatcatgcccagctaattttttgattttttttttttttttgtagagatgaggcctcactatgagcctaggatgatctcaaattcctggcctcaaacagtcctcccgcctcagcctgcccaagtgctgggattacaggcataagccaccatgcctggccttttcttcaaaaataacccttcaatcaattttttttttcctggtcaaattggattttgtgtttcttttatatattccttgtcaggccctacagttattttaattttgggtgttggatagactagggttcatattccatgcctgccatgctttttgtgaacttgggcaaaatagttagctcttctgagactcacttttgtcacctagtaaatgggttcagctgtagtactctatgtatttgtttgttttaagcattagatagtgcgtggtaaatgcttagcacagttcttagcacatagtaaatctttaataaatgttagaaaatataatgatcttgattctctgtcttccctccctagtagttgatttggggcacagtgtagcattatttgaattatcacagaataactttttacctttctgattttaacaggggagagtgtgtaaaggatgggagagggaagagagaaaaaagctgagtaaatgtgatcaactttacagtctttattccctgaactatctttccctgagttatgtgacacattctccttgttttcctctttctatctttgtggccactcctcagttccctaggcccctcttctttgaccactccttgtttgagttaccaaagattccatctctggccttcttgtgttgattctacacgttcttcctggaagcacatgtccatggtttcagcttccttgctaattaggagaaactttgtcctcagaacccatctggattacagccaacagcctactggtctccattgggctatctcccaggtacctataacagtctcagaactgactcatcttccttttcagcgtgttatttttataatctctatcttgatgaatggcacaacacagtgacccaaactggaaacttgaatgttgttcatctggttggtgatctgttcctaactgttttacatctgtaacatttctcaaatttgcctattttccaccatttctcctatcccttaattcaggctgcttctcacctagatgactgctgcaggttcccttgttgtctactcattattagtttctcattccaagtcattgattagatggctgccaaaagtgatctctttaacttcccaactttagattctgtgaataaaatccaaactccttaacagagcaggccctcatgatccaactcctcttaacgttggtagccttatcttttctctgagcccactgccgcttgatccttggtggtgctgtgctctttcttgctctctgtctttggttggactgcccacctccctccttcttacttgacattataatttatcagatagagatcagctcctccagtcagcatttccttactgactactccaagtctgacccagtgtagattctgtgcttatatctgtcaagtcacttattgtatgataattcatacacttatatgataattcacacattggcatgtgtagattaaacatttatagtctcagaaggatcctgatagtccaaaaggtatagtaatgcagttgtctcttagtatcttcaggtgattgattccaggatcccccccatggagatcaaaatccagggatactcaggtgccttatataaaatggcatatttgcatgtaacctatgcacatcctcctgtgtactttataggccctaaataatctccagattacctatatggctaaaacaatgcaaatactatgtaaatagctgttatactgtatttttaagtttgtttcttattttatggttttatttgtttatttttttgatctgtggatgtgcaacccacagatagagagggtcaactgggccgggcgcggtggctcacacccgtaatcccagcactttgggaggctggggtgggaggattgcctgaggttaggagctcgagaccagcctggccaatatggtgaaaccgtgtctctactaaaaatacaaaaattagccaggcatggtggcaggtgcctgtaatcctagctactctggaggctgaggcaggacaattgcttgaacctgggagttgaaggttgcagtgagccaagatcctgccatagcactccagcctgggcaacagaatgagactctgtctcaaaaaaaaaaaaaaaaaaaaagaagagagggccaactgtatgtaatttactgaagcatggattcacattatagatggtccctgatttatgatggttcaacttatgatttttatactatgatggtgggaaagctggtgtgatatacgtattcagtagaaattgtacttccaattttgaaatttgatcttttcccaggctagtgatatgcagtgtgacaatttctcatggtgctgggcagaagcattgacccacacctcccagtcagccatgtgatcaggagggtaaatgagtatactccatggtgtactgtgttgccaggtgattctgctcaactgtatgctaatgtgagtgttctgaacacatttaaggtaggctaggctaactatggcattcggtaggtaaagtgtgttaaatgcatttcctacttaaacgatattttcagtttatggtgggtatattggaatatagccccattgtagggcaaggagcatctttatttacccagttgagtttagtggcagcagaactaagttcggtttagctgttcagtgagccaagcctcacttagcatctaattctgtctttattttctgctttagataggccacagctctcctgaagggattaagactttctgtgtgaaaaatggtattcagaaggaagccagcattaattctgtttttatacatttatgaagatttgaaggaatttcactgtcaattctgtcttaattgtattctgtataataaatcataatggtatccaacggctcttgaaaggtttggtttttgtgaacatttctttgaatgtcaaagttgtattagtttgtttctcaattaaactgggtgctctttgagggcagggatttatgggacttgtttgttttgcagttttatatctccagctgctaatgcagtgcctggtttgtagtaggaatgagagatttactccaatagaaccatactaaagatcttacacttatggattacagttgatagctttgtagagtgaactggtattccctttaaatgagacgacatgacctgagtataaagtataatcaactacatgactccagcaagaataccatgtgtccctcagatagcatagctggcagatggagttatgcacatcaactggacatttaagacagctggagatttcttacatttagatgacagtttagattagaaatatttaatcttagctgtacttaatatattatgtagctatatgatacatcatgtatatatggtatatcatatatatcatatatttaatcacatttaatccttagctatattttcatccccaaaatggtatatggatctgtttttattgtcagctggttatttattgttgcttatccatggctcatgaaaatcttcatgttacttgggaaatctttcactctgccttttgaaggacagcccagaaccatttccttcttggcacatgaccttctaacccagtgaccaaagagtatgtaaaagcatggtacacactgcttttgaagattacgtgtgtctattctagatgtgtcttatttcttgcagatatattgcctacaaagattttgatatatatatatacagtagactatactatataattaatatttataccagatattaaatatataagcattctactagaactaaagttaagaatttgaaatagtctcatgtgagtaattaaaataacaatagcatctttttcaagaaagttttttttaatatggtggagataatgacatggaaaaaagtagttaattatttttggtattcccgtatttcatcagtaggttgccatagaacataatagttatataatcaaacagcagaataattttatatgaggtttattgatacagaaatgtttggttcagtgtttgtcttccagttttgcagattttcttttcgattttaaaactggagaatacattaaaaccagaaactttcagcctctataatgccctcaaaactcagcaggttttgaaaatgcctcttccttctcttctcctccccataatcctgcttatttttggcattaagtgagtcaggggttccaaacccaaatacgtttttcaaggctatgtagtcagtgtgaatgagagaagtaaatctgttgggtcctgtgccacactggagtttccaaggctggtctaaatgagttcaacttcagtttttttgtgtttttttagagatggagtcttgctgtgttgcttgagctggtcttgaactcccgggctcaagtgatcttccagccttggcctcccaaggtgctagaattataggcatgagccactgtgctggccaatttttttttttttagcccactgtgctaccagtttgtgatcttcactttaactgtgaaaggactgtcaaagattgtacgtataagatttagtttgagagccaggcctggtggctcatgcctgtaatcccagcactttgggaggctgaggcgggtggatcacgaggtcaggagatcaagaccatcttggctaacacggtgaaaccccgtctctactaaaaatacaaataaattggccaggcgtggtgacgggcgcctgtagtcccagctactcgggaggctgagacaggagaatggggtgaacccgggaggcggagcttgcagtgagcagagatcacgtcactgcactccagcctgggcgacagagcgagactccttcacccaaaaaaaaaaaaaaaaagtagtttgtctttctctttgaaactgaattcattaaacaaaagcctaaataactatactattacttgttatttatttatttatttattttagacagagtcttgatctgtcagcaggctggagtgcagtggtataatcttggctcactgcaacctctgcctcccaggttcaagtgattctcgtgcctcagcctcctgagtagttgggactacaggcatgcgtcaccacacccagctaatttttgtatttttggtagagatggggcttcaccatattggccaggctggtctagaactcctgacctcaagtgatccacccacctcagcctcccaaagtgcataagtgctgggattacaggtgtgagccaccacacccagcctactacatattcttttagacccagctgaaatatcacgtaattgctgaaggctcctgaactcttccagatcagggattgattttcctcattttaagattgtcatgacaactgtagtattgataactgtattttattttattttattttttttgagacagagtgttgctctgtcacccaggctggagtgcaatggcacgatcctggctcactgcaaacttagcctcctgcgttcaagcaattctcgtgcctcagcctcccaagtagctgggattacagatgtgcaccaccaaacacctggaattagtctggctaatttttgaagttttagtggagatggggtttccccatcttggccaggctgttctcgaactcctgcctcaagtgatccacctgccttggccttccaaagtgctgggattacaggtgtgagctaccgcacccggcttattaaccaatttttaatgttcagcacaacttgatcatgatgtacaatgtcttttttatgttatgtgttgatggagtcaaattaccgatattttggttcagttttttcaataagagatcaggctattttctgattttcattctgtttttttctttgatctgtatgtatttataagtgtctcttattttcaaataggttttttctagttatctttttgtaacggatttatagattatacattgtggttaaagaatatggtctataggctgggcacggtggctcacacctgtaatcccagcactttgggaggctgaggcagggggatcacttgaggtcatgagttcaagaccagcctggccaacatggtgaaaccctgtctctactaaaaatacaaaaaaaatttagccgggcatggtggtgggtgcctgtaatcccagctactagggaggctgaggcaggagaatcgcttgaacccgggaggtggaggttgcagtgagccgagatagtgccactgcaatccagcctgtgcaacagagggagactccgtctcaaaaacaaaaacaaaaaacaaacgaaaacacacacacgcaaagaatacggcctacatgcactttcagtcctttggaaattgttggtatttatttgccatttggcctagtttacccagattccacaggttgttaatgttgtacaattgcgtcttctctttctcacttcacccatctatgtaatttttctgaatcatttgagaaataagttgcaaacataatgctgtattacccataaatcagggtgtgtttcctgaaaacaaggatactctcctataaaatcaggaaataaatattgatataatactgccatctgattcacagaccctactcaaatttcactgatcttccaattatgtcttttatagcaaaaacaaaacaacagaaaccaacaaaattccctcaagaaaacaaaagcagaaaaacttccctttccccttcacttatttctgattcagggaccattcaggattatgccttgcgtttagttgtcatgtctgttcagtctcttttaatctagaatagttctcagtctttccttattttcagtgatcctaatatttttgaagagtagagaattattttgtagcaagtcccacaatttgggttagtctgatgtttccttttgaatagatttaggttatgcatttgtggcaggaataccaaagacacgatattatgttcttctcactgcatcgtatcaagaggttcatgtcaatttgtccaattactggttatgtttaattttaccacttggttaagatgttggctggcaagtttttgtaaaattagtttagaggtatttcatacttactggttagtaagtaataatgcattttgtggggtgatgctttgagactatataaatagcttatttctcatcaaatttttgcttgctagttttaccatccattggtgatttgtgcctgaatcagttattatagtggttgctagatggtaaatttaaaaaatttcattatttcttctgaattcatcacttggcatttctttttttttttttttttttttgagacggagtctcgctttgtcacccaggctggagtgcaatggcgtgatctcgtctcactgcaacctctgcctcccaggttcacgtgattctgccacctcaccctcccaagtagctggggttacaggcacccgccatcatgccctactaatttttgtatttttagttgagatggggtttcaccatgttggctaggctggtcttgaactcttgacctcagatgatctgcccaccttggcctcccaaagtgctgggatcacaggcttgagccaccgtgcccagccaatcacttgctatttcactctaaggaaaagctttctctctctggtttttgtctttgtttttgtttgtttaaaaatcttttaaacatatgagcacagcctcattgattcttattttgttcctttttcatgtattttttgatattcaaattgtcccaaatttggccagtgggaaccctttcaggctggctcctgtgtcctttttccatgtcctcatcattctttttttttttttttttttttttgagacagagttttgctcttgttgcccaggctggggtgcaatggcgtgctctttgttcactgcaacctccacctcccaggttcaagcgatcctcctgcctcagccacccaagtagctgggattgtaggcacctgccaccacacctggctaatttttctatttttgtttttattttttttattttttgagacggagtcttgctccgtcgcccaggctggagtgcagtggcgcgatctcggctcactgcaagctccgcctctcgggttcacgccattctcctgtctcagcctccaggcatgcgccaccatgcccggctaatttttttgtatttttagtagagacggggtttcactgtgttagccaggatggtctcgatctcctgaccttgtgatccgcccacctcggcctcccaaagtgctgggattacaggcgtgagccaccgcgcctggcaatttttctatttttagtggagacaggatttcaccatgttggtcaggctggtctcgaactcctgacctcaggtgatccgcccgccttggcttcccaaagtgctgagattataggcatgagccaccacgcctggtcatgtccccatcattctttgatcactttttttcttactttttggaataataagattttctgtgggctgggcgaggtggctcacgcctataatcctagcactctgggaggccgaggctggtgggtcacctgaggtctggagttcgagaccagcctggccaacatagtgaaaccttgtctctactaaaaatataaaaattagccgggcatagtggcacacacctgtagtcccagctgctagggaggctgaggcaggagaattgcttgaacccgggaggcggaggttgcagtgagctgagattgcgccactgcactccagcctggatgacagggcgagactccgtctcaaaaaaaaaaaatttctgggctcatctttacttttgttatctcagtcgtggaatcaataattttatcagggaaccctggttccttttattagtgaatgtacttagaaaataaaatatgtgcactactagatatgttctttctattggggtgttcttccttttaggctctatgtgaggagagaactagaatattgttttaaaatgtaccaggtaatcccagcactttggtaggctgaggcaggcaaggctggcagatcacttgagatcaggagttcgagaccagcttggccaacatgatgaaaccccatctctaccaaaaaacacaaaaagtagccaggcgtggtgacacgcacctatagtcctagctagagtgagatagagtgagaccctgacttaaaaaaataaacaaataaataaaatatactggaatttaatttataggtatgaatgacacagagaggccaatattattgaaaatgtgttactcacagttcttctgaaacagcaggcgcaccatactatgcaggaccacatggggaagcaccagggtgggtcaggaggcagaaggaaccagaggaaaggatgggtgagttttttttttgttaaagtgctagaaagttgttaggtgggacatcccctattgagcagaaagagaaacacaaatgttgagatttgtggttggacggtttgtaatatgatttttgtgtagcctcaaaaacacagagatggtatgaatgtaaacaactttggtcgttaatttggcccatcctttcaagatgccaaatcatcaattacagaatatcaagaatgattatataggtatgtatgcatgtctatacatacatatatacatctgtatcttcctgtaaataatgaaagccatggtttcattccaatactcttaattctagtccaacacaatagggtttcttctggtgtttcccttttctgacattgaaaaatctgaggccaggcacagtggctcttgcctgtaatcccagcactttgggaggccaaggcaggtagatcacttaaggtcagttgctcgagaccagcctggccaacatgatgaaaccccatctctactaaaagtacaaaagttagccaggtgttgtagtagtggtcgcctgtaatctcagctactcgggaggctgaggcaggagaatcgtttgaacccaggaggtgggggctgcagtgagctgagatagcgccactgcactctagcctgggcgacagagtgagactccatctcaaaaacaaaacaaaacaaaacgaaaaatctgcctcctttttttttttcattcattcattaattctttagatggggtcttgccctgtcacccaggcggtagcgcagtgacacgattatagctcactgttgcctcaagccatcctctcgcctcagactcctgagtatctgggaccatacaggcacgtgccactgtgcttggctctcacattgtcctttttactcaccttcctgttggtgacaatctcctgactatgtaggccattttcttgcccccagccccactgaatgagctggctgatcactccttcaagttccatgagccattgttacatacaggtagtactcagtttgcttggttttgatattcataaatttccattgctgtggtttaattaaataatgccagtcctcaaatagcagttaatgaaatacaaaatataacctgtgatcaagaaaagcttctcaggtgggcgtggtggctcatgcctgtaatcccagcactttgggaggccggggcgggtggatcacctgaggtcaggagttcgagaccagcctgaccaacatggtgaaaccccatctctactaaaaatacaaaaaattagctgggcgtggtggcaggtgcctgtaatcccagctactttggaggctgaggcaggagaattgcttgaactcaggaggcataggttgcagtgacccaagatcaagccattgcactccagcctgagcaacaagagcgaaactccatctcaaaaaaaaaaaaaaatagcttctccaaaattttaaaaatttaccctgaccctgaaatagttgattgttccctccctagacatcattcagttggagctagcctaattttgttttttttgttttgttttgttttgagatggagtcttgctctgttgcccaggctagagtgcagtggcgcgatctcggctcactgtgacctctgcctcctggttcaagtgattctcctgcctcagcctccagagtagctgggattacaggcgcgcgacaccacacctcgctaatttttgtatttttggtagagacagggtttcaccatcttggccagactggcctcgaactcctgaccttgtgatccacctgcttcggcctcccaaattgctgggattacaggcatgagccaccgcacccagcctttttttttcccttgaggagaattacagtctgcactgctctcagctgaactttacacagcttttacatttccctctgtcagttcctcttgtaatggtgggtgggtagctgaagggaggatatgtacaataatgtatttttagttcctttgaacagagaggttgcttcagccattgctattgatggcaggaagtatatttatagctccagggaaggaggggtagtacgactgctggtttaagaaaacctgggagattgtatttaatatatgttgttaaaactcatttgtactttattgtaagttcttgccttagaaatgcagctgagatgaatgaacctgttacttatgttatattgttacttatgttatatatgttatatgtattattgtaagtatattgactctgctccctaatttggaaaaatcttccgttttgaaattttacaatatacaatacctaaaacaaagagtacttctagagcatacaggatgtatgtggagaattcaggtgttagcatgcaattgaacagtaaagatactgactagcagtataaatatcgtccccatttagatattttattcataaagttcttgttggtgtagcttttattgtgattttttcttttttttttttggatacagagtctcgctctgtcacccaggctagagtgcagtggcgcagtcttagctcactgcaacctctgcctcccaggttcaagtgattctcctgcctcagcctcccgagaacctgggactacaggtgagcattaccacactggctaatttttatatttttagtagagatggggtttcaccatgttggtcaggctggtctcgagctcctgacctcaggtgatgcacttccctcggcctcccaaagtgcagggattacaggtgtgagccactgcgcctggccaattgtgatttttttaaagattgaaaccaaaatattttatacagatcataagatattcttggtaaacactaagcacctcataactttaccacaattttgattgcacaactttcacctgtggttatcatgtgcaatgggcacattcaacacaaatcaaattattctgaagcttgctttctttcttttttccctactccctttcttaattgaggggagcaaaaagttggtttccagggatatgtcttctctcttatgctggtcccagattgatgcagtcatggaaactaggcagtaaactcattcttggcagctgccggcactggtctgattctttcttttaaaagcatgagattctttaataacacatattggaaagattgatgccaagtgattccaggtcatcctagaggaggcttgggaacattgttgaatagatttaaatgattcagttaagtgagtgatttaacccaaggtttgtgtctaatttaaacaggacctataaaatatagaacaattggtttgtttcttttttagaatattgaagattagattttaatttgagaattttactaatttgagggttttattttttgtttttaagcgttcaaaatgttgaattgtagatatgctgagttttataatgagcacaatgaaggtttttcaactggcccgttaaagccaacccactaatgaaatgaaaatatgaaatattatgactccataatatttcatggattttgaagctgggctgcctgggttcaaatcccatctctgctactttttgggtacgtaaccttgtgccagttacttaacctctctgtgcctcagtttcttcatctgcaaaatgggagatagtgcagtttgagtgttcctaatctgaaatctgaaatgctccaaaatctgaaactttttgaatgcctacatgactgctcaaaggaaatgcttattccatggagcatttggatttcggatttttgggttaagaatgctcaattggtaagtaagtgtaatgcaaatattccaacatctttaaaaacctgaaatccaaaccacgtctggttccaagcattttggataagggatactcaacctgtaaataatgtctgtttcatggggttgtgatgtggagtaagtgagcaaagttgtgtaatgtgcctagcttatagggaacacttagcaaatgttggctattccatttatatataagaaatagaattattggctgggtgtagtggctgatgcctgtaatcatagtgctttgggaggctaaggtgggggattgcttaaggctaggagttcaagaccagcctgggcaacatagcaagactctgactctgcaaaaaaattcacaaattagttgggcgcggtggttatatgcctgtagcccttgctactcaggaggctgaagcaggaggatcgcttgagcccaggaatttgaggctgtggtgagccatgataatgccactacactccagcttgggcaatagagtgagaccccaacttaaaaaaaagaaagaattattgatgggattgtaaaggctgaatattaaataaattcagaggaggtttttacggaacttatttgtgaaatatttttaaaggaaggaaggcatgtttgttttaggtttataagagatggcagatttaggaagctcctccctactccagatgaataagccatctgtttttctatcccttttaaggatttgcttggtgggtttccataacttttttttttttgagactggatcttttacccacccaggctggcgggcagtggcgcaatcatggctcactgcaacttcaatctcctgggctccagcagtcctcccgcctcagtctctcttgagtagctaggaccacagacgcgtgccaccatgcccagccaatttttatttatttttttgtgtgtgtggagatagggtctttctatgatgccccggctggtcttgaactcctgggctcaagtgatcttgctttggccttataaagtgctgggattacagttatgagccatggcgcccagtctatgtattcttacaaaattaaattcatgttaagtgctacactagcagaatttttaaaatttttaaatgatgcacaaatagagaagagagagtgcaaattaacgagaaataggcaagactaatttgaagaaaactatgaagctttactgaaggatttttttaaagatataaaatgctggccaggcgcggtggctcatgcctataatcccagcactttgggaggccgaggtgggcggatcgtgaggtcaggagatcgagaccatcctggccaacatggtgaaactccgtctctactaaaatacaaaaaattagccgggcatggtagcggatgcctgcggtcccagctactcgggaggctgagctggaagaatcacttgaacccaggaggcagagttgcagtgagccgagatcacaccactgcattctagcctggctagagagcaagactccgtctcaaaaaaaaaaaaaaaaaaagaataggcaaataactagagaaaaatagtccagaaacagacctgaatatatataggaatttagaatatgaaagtgtcagtgtgtaggaaggagtgaaatgaaaaaagaaagaaaaaaggaatatgttgaaagtggcattcagaaatcagggagaaaatgatcgattactaagaatgatcctgtaacagtgggctgtttggggaaaaatacgtaaagatttctaatttagactatattcaaataatcaccaaattatatagagcagggatacccaacctccaggccacagaccatcctgttaggaactgggccacacagcaggatatgaactttaggccagggaacattacacctgagctctgcctcctgtcagatcagcagcagcattagattttcataggagcacaaaccctactgcgaactgtacactccagggatctaggttgtgtgctccttatgagaatctaatgcctgatgatctgaggtgttgcagcttcatcccaaaatctgaaaccatatcctccacccctccatttcatagaaaaattgtcttccacaaaactggtccctgggtgccaaaaagattggagaccgctgataatagagtatatataatcaaattacagaaataaccacactctattcttcctctagaatatactgaatgtttcctaagaaaagttgaacactcatggctggttggctgctctctagcacatcttgccttcgtctctcactagttgaattttacacttccaggggtcagtatgtttgttccaaatctgcttatgccagttacatttagtactgtaattttataatttaattaaacattaactaatgaaatatgactgcaaaaagtagttgtttttaggaaaattaagttgtagatcttgaacaaattggataaatacaaatccccttttccccttttcaccaaattactgtcttactaattgtgggcgtgaatattttgaaagattgggggtggaaatcataaaattcttttttttttttttttttttttttgctcttgtttcccaggctagagtgcaatggtgtggtctcagctcaccacaacctctgcctcctgggttcaaatgattctcctgtctcagcctgccgaatagctgggattacaggcatgcgccaccacacctggctacttttttgtatttttagtagagacatagtttctccatgttggtcaggctggtctcgaactcctgacctcaggtgatccacccgcctcggcctcccaaagtgctggtattacaggtgtgagccaccacacctgacctcgtaaaattcttaaacgatctatactcagttgtcttacagttgcctagattcttgttccatttaaagaaactgaaatttgaaatcacaaatgtggattatggatatgatgggttatggatatgatatatttgtaatgaatatgcaagagagaacatttgaaacattaattagtagaaatgtacttaaagaagaggccttggttttttaccgtaatattggcaggtgacatgtatttgttttgagtaaaaatcaaatatttcagttacatttttaaaattacctgatatactgtactttttcatgtaaccagtcagccctgagtcctatttgtgttagataagtttttaccaatcccagaaggagatagaggacaagcttttatatgcttcggctgaagaaaacctttctccaaagaagtaattatctgatcctcctataaagggccagatagtaaatattttagattttgcaggctgaagtagaatcaagggtaatacgtacgttctgatataacaagagagaaaacaaattttgagaaatttcttaattgattaaattcaaaataataaacacaatttattgaaatacaggtatactaatgagaagaatggagttcttttcggagtgataacattttcttaattggagttcagagttagtgcttcctattcaataaataatcatcaaaattgattgcaagtatttatctattaatgcaggtctgtaatgaggttttatatatttcatctttgacatgtcttcacacatacatgtcaaataattgataccagcccataaacatatgattttaattgagcatattaataactcaggaagcatttatagaattaggtttttcttataacatttaccttttagtatattattcattgctgcttaattacttccaatggaaggttagacagaagctccacaattgcactgttaaatagatactgaaatatagatatttccttgtgcattaaggtcctaaaaattattctggaaatgtagtgtgagctaagaaactatatccactgcaaatttgtttgggaatggagatctcacttcttgttttaacttttgatagcatgtaaagtgtataaagcagctcaacgttgcttatgattcaaaagttagttgtctaaataacaacagtttaagtttcatatataagtgttgttctgtcctgtaattttaagttgaatttactattataaaattagcaaaagctaattctcaaagccatttattgtttgatcatagtgtctgaaagcagtcttattgttgtgaaaaatttcaatctcagttccaagctgaaaagaaaaaaaaaaaagcatgataaaactttagtacagctcagccgtcaaactgctgtgtgcctgggcaagtcaggttattcagcttctgtttctgacaatggttaagcccatggcagtgaatgaaattcaccattaacatggttggtttaataattcatgataaattcagatatttttcatagaatatctattgataaaaaacatgaataaccaccttacattttcacgttttataaatcacccaactaagcctttttctgcttcacacatatttttaccattatcaatgataacgtatctgagattccactttaggttatatggaattagtactttttcaccttcttgtttgtagttgttcaacacagactattcatagaagctaattcttcagttgttttaaacttggcactgactccttgaataaacatctgaacagtgttgtaacatctatcaaactcattcaaaagagatggaaatctacttaacctcaattgccttggttttttttttaaacagattattgatcttgctcctaatattttcgacttttagagcaaatgattttgttgaaaggctaatagtctttttttctttttaaattatcttatattaaatttaaaaaataatttttttgttacctgtctggagaaagcctagagaaaggctaattaatactcttaaacaagtttattttctctggatacatttcttcagcttcttcatgatttaattcacttatcactagaatattacttttcttgctttgctaacaaatgagctacttagaaacttccctcctttacaaactttctattccttaccttccctccttgctgtaatgaaatattccactttaaattttcaaatttttctgaccattgctttcctgtgaatcggaaatactgtgatcggtccttagtttggtaacattgatgtattttgaattcttttagcacagacagacagttgactccttgaacaacgcagtttcaaactgcacaggtccaattatatgagaattttttttcaataaatacaatcagcagtttatacatatacaaccaaacgtggatcaaaaatacgttatttgaggaaacccccagatacagaacagtgaaatttttgtatcctctgggccactgtgggacttgagtgtgcatagattttggtatccacggttgatccacagataccaagggatgaccgtagagtcattgcataataaacaaaatgcttccctatcttgtcttgataaaataatgcataccctccactgtgccttaaaagcatgacattcaggctgggtgtggtggctcacacttgtaatcccagcacttttggaggccagggtgggaggattgcttgagcccaggagttcaagaccagccttggcaacatagtgagagtccatctctagttttaaaaaaatacaaaattaaaaaaaatgaaaaacatgacattcaaagtgcatttgtttttgtttcgacatgatggttatgcactaataactaatgatagttatgtactaataaaatgtcaaaataataacgacttttagttactgataacagttatgcattaataaaaaataaaatgtcacagtatgacaatatgcatgtgtggcaccaaacatgctgttgagttataactttgtgactgtgatttgtgggatactgagcagcagtggaaagctatataagccactccactctgccagtcagtacagtggctgattaccaattatggataaccagaacacatcaaaaagcagttcaacaaggatcagaataataacatgtaagtaccatttattaagtagttatgtgtaaggcactgtgtcagactgtataatgtacattatttaaccttcaaaagattgagagggaagatcccttgagtctgggaggtcgaggttgcagttagctgtgattgcaccactgcactctagcctgagtgatggagcgaaatcctgtctcaaaaaacaaaacaaaacaaaacaggcctggtgcggtggctcatgcttgtaaatcccagcactttgggaggctgaggctgaggtcaggagtttgagaccagctgggccaacatggcgaaaccacgtctctactaaaaatacagaaattagttggtgtggtggctcacacctataatcccagctactcgggaggctgaggcaggagaattgcttcaacccaggaggcggaggttgcagtgagccaagatcatgccactgcactccagcctggatgagagtgagactccatctccaaaaaaaaccaaaacaaaacaaacgaaaactacaaaagattgtctgaagccagccacagacaatagtaaatgaatgagtgcagctacattctttcttatttatggatgcagaagtttgaatttcatataatttttccgtttcacttatatataaattatatattatatattacataatatataatatatattataagataatataatatatattagataatatatataatataagataatatatattagataatatatataatataagataatatatattatataatataattaaaatatattaattataatatataatatatgacatatatatgttatatattgttatatataatatgtgtaattatatattataatatatgatatatatataatctatcatatatcatatatataatctatcatatatcatatataatctatcatatatcatatcatatataatatatatcatatcatatataatatatatgatgtatagtatatatgatatataacatatatataatatatgatgtatagtatatatgatatataacatcatatatactatacgtcatatataatatgacgtatagtatatatgatatatgatatatatactatattgtatatgatatataatatgtattgtatattatatataatatatatataaggcacagtggagggtatgcattatatataatatgtattatatattttatatattataatatatattttatatataatatattttgtatattatatattttatatataatatattttgtatattatatattttatatataatatattttgtatattatataatatataaaatgtatattatatataagtaaagtatatattatatataatttttatatatactttttttttttttttttttttagactggatcttgctctgtcacccaggctggaatggagtggctgggactacaggtgtgtgctatcatgcccagctagttttttttttgttttttttttgttttttttaattttttttttttttttaagacggagtctcgctgtcacccaggctggagtgcagtgacatgatctcggctcactgcaagctccgcctcccgggttcacaccattctcctgcctcagcctcccaagtagctgggactacaggcacccaccacacgtccagctaattttttgtatttttagtagagacggggtttcactgtgttagccaggatggtctcgatctccggacctcatgatccacctgccttggcctcccaaagtgctgggatcacaggtgtgagccaccgcacccggcctactttttattttaacttttttttttttttttgtagagatgtggtctcactgtgttgcccaggctggtctcaatctcctggggtcaaacagtgctcctgcctcggcttcccaaaatgttggtattacaggtatgagccactttgcctggctatcttataaataattttgatgttaggaatttttagttgcttttatttttatttttgttgttttaaatatttattaatagaagcaaggggtggataaatcttctagatcaaactcttccttaaaatagttctgcttttggtaggattccagattttcctagttttgttaagtgtttctaatgatgtttggcataggtgttaacttcatgggcctgttgtatacaaaccaatttttttcttgctctgagtgaacagtaacagaacctggtaggtgagtcacactgatactgcattcactgaagttactaagctgaatgataagagatgagaatcctttgcatttgtattcaaatcaagagttgtagaatttgaaattcctgttttgatgaactatgtgaagcatgctgtcattcttctctgctagtctatgttgatgatgtcattaaactagtctttgacttttagttcttggcttaaaatattggaatgattatataataaataggtttatttcatgtggaaaaggaataatgtgtttgccctgaaatagtctgatctgatcaggaggatattatgctgagcatggctggaaataaatttgtagcaccaattaaatacactgtagcagctctgagagggaataaaagtaaaatataaatagtaaatatgagagaaagtgactatgggatctaactatgtaagagcagggtgggagtatgggtagatacgtacatgccccctagattttaggaaagcatatttcaagaagtagagaagacatggatatcaatcagtggaaatcgtatactaaaacggaagtcagtgaaaaaaaaagactgctctcaaactaaagatagatggttgcttctaataggtaggtattcagattcgattaagaaattagaaggccgggcatggggactcaggcctataatcccagtactttgggaggtcatggtgggcagatcacttgagcccaggagttcgagacaagcctgggcaacctggtgaaaccccatctccacaaaaaataccaaaattaattagcagggtgtagaggcacatgtctgtattcccagctactcaggaggctgaagtgagagaatcacttgagcctgggaggttgaggctacagtgagccgagatcacaccattgcactccagcctgggtgacagagtaagaccctatctcaaaaaacaaattttgaaaatatacagaagtatagaaaaactgaagtaatttaatttgtgttaaaatctgtttggtattaaaactaatgtttggccgggcatggtggctcacgcctattaattatcctagcactttgggaggccgaggcaagtggattgcttgagctcaggagttcaagaccagcctgggcaacgtggcgaaactccgtctctacaaaaaatacaaaaattagctgggcatggtggctcacgcccgtagtcccagctcctttgcaggctgaggcaggaggatcacttaagtccaggaggtggaggttgaagtgagctgagatcgcacctctgcactccagcctgggtgacagagtgagaccctgtctcaaaaacagacaacgacaaaaaaccctaatgttttatgaaaaagctctttaatttttcgtgaccaaactgctattctctagacctacactgtccaaaatgatagccattagccatgtgtgctactgtgttggacagcacgtatttagaacatttccaacatcacaaaagttctattgcagaatgctatgaaaatgagatacactttcattagaaaagctagtaaaaataagtaggggtaatggggtactttgactatccagaaattttactaaggaagaattagatttttataatactgggacattagtgtgcactttttttgtcgtaattgcattttgttttttattttgaaataaatacatgtacagaaaaattgcaagaatagttacagagtcttttcgctccctgaaccattagagagtgagccccatcagccccaaatactttaatgagcattaaatctggagtttggccgggcacggtggctcacgcctgtaatcccagcactttaggatgacgaggtgggcagatcatttgaggtcaggagtttgagaccagcttggccaacatgatgaaaacctgtctccactaaaaatacaaaaaaatgagccgagcttggtggtgcacacctgtaatcccagctactcaggaggctgaggcatgagaatcacttgaacctaggaggcggaggttgcagtgagctgagattgtgtcactgcattccagcctgggtgacagagtgagaccctgtctccaaaaataaaataaaataaatctggagtttaataccagtacagtactaccagcttatcttcaggccccattcgagttattctagttgtccccaaaaggtgaaggatccagtttaaaatcacacattgcatttagttgtcatgtctgtctttgacttgatcgccttgacacttttgaagattacaggctcattattttgaggaagtcattaacatggacctgatgtttcttcatctttagattcagattatgcattttatcagaattgccacataaattgtgctgtgttcttattttatccatccaggtactacataatttccatgtgtcccatttttcttgatgttaaccttggtcacttgattaagattgtgtctgccagttttctctaccatacatttaactattttttcctttataatcagtattttatgaggaggaggaggaggtactttgagacaatgtaagtatcccattcctcatcaaactttcaccttctagttttagcacccattgaaatttttttgctggattattggtatgatggctgccaaatgatgattttctaatttcatcatcccttctacatccattcattgacatttcattgaaaggaaaaactgttttcttcccatttatttaacttatatcaatatggacttacggattcatattttattcaataagttatctattagtgtactttggtactttgatgctgagtttgtcccagatttggtcagtggaaaccctgtcaagctggcttctgtatccttttgacattgtcctatcattctttgatcactttcctctttctgggaccagatatgatcaaagcccttcttatacttttcctgccctacctctggaatcatttcaccaaggtaccctggttccctttattgaagaatgtatttagaggttaggtctggacagtagatggcattgttccactgaggtgtcactgctcctagactttctcagcagacagagctagagcatatatgcatgtatatacatacacaaacatacatccacacacatagactcatttttttatttcttgctctgtgtgtgtgtgtgtgtgtgtgtgtgtgtgtgtgtactgtgagttcacactggtacctagtacctcaacacctcagagttcattttatttttcttcctttttgtatttgtaactcccttctctgacagagaaactgggccccagtttttcttaatatattactatttacttaattgatcaatccccttgaatgtgcccagtctttcctttccttatcagatcatgtgcatgctaaccttgctcagccccacctaatggtttttagactgaattatttggagacgaaaaaagtacggttgatgctcattagtcacagattttttttatttgcaaattcacctacttgctaaaatttatgtgtaaccccaaaatctgtactcgtagcacttttatggtcattcatgaacacgtacagaagggtaaaacatttgagtcgctattgggtaacgtgtattcctaggtgaggccaagcaaggcagtctactgccttcttctttgagtcctcatactataaatagttgtcccttttgcagtttacttagcgccacatattttgcattttgacttcttttacttagcatgtgttttcaagttccatccatgtttatagcatgtatcagtacttcattcttcttcttttttttttttaaagagttgggggtctcactgtgttgcaggctggaatacagtggctattcacataggccatcatagcatgctgtagcctcaaactttcactgggctcaagtaatcctcccacctcagcctcccaagtagctgagattagaggtgtgggccactgtaccaggttccttcctttctaaggctgaataatagttcattgtatgtataataccacattttgtttatctattcatccaataatgggcatttaggttatttccaccatttggctatcttttgaaaatcttttcatgtgcttgttggccattagtatatattctttggagaaatgtctcttaaattctttgcctattttttaaattggggggaagttgtctttttttgttactgaattgtaagagttctttattctgataactagacccttatcagatacatgatatctgattaacacatagtttcttgcatcccataggttgtctttcaaaattttgacgaattccaatttgtcagttttgttgcttatgatttttagtgtcatatctaagaatccattttcaaattcagtgtcatgaagatttacctatgttttcttctaagaattttatagttttagaccaagcgcggtggctcatgcctgtaatcctagcactttgagaggctgagacaggcggattgcctgagctcaggatttcaagatcagcctcagcaagatggtgcccatctctactcaaatacaaaaaattagcctatggcgtgtgcctgttcagctactcgggaagttgaggcaggaaaattacttgaaccatggaggcagaggttgcagtgagccgagattgcatcactgcactccagcctgggccacagagcgaaactatgtttccaaaaaaataataacaataattttatagttgtagctttttaagtttttaatccactttgatttttttgttttgttttgttttttgagacagggtcttgctctgtgctgcaggctggagtgcagtagagcagtcttggctcactgcagccttgacctcctgggctcaagctatcctcccacctcagcctcccaagtagttgggatcacaggcttgtgccaccatgcctggctaatttttgtattttttctagagatggggtttcactattattgcctaggctggtcttaaactcctgggctcaagtaatccatgcccaccttggcgtcccaaagtgctgggattacaggcgtgagccaccactttcagtcccaagttaatttttatatatggtatgaggtaaggattcattcttttgcatgtgaatatccagttgtcccagtgccatttgttgaagagcctgttctttccccattgaatgttgtcttagcactctttccaaaaattagttgaccatagggcatggtggctcatgcttataatccaagagctttggaaggcccagatgaaaagattacttaaggccagtatttcatcaccagccagccatggtggtgtgtgcttctgggagggtgaggcagaaagatggcttgagctcgggtgttgaaggctgcagtgagctctgattgtgccactgcactccagcctgggtgacagagtgagacactgtctctaaaaaatagaataataaaaatcagttgactatagatttgtggatttatttctgaactcatttaaaactattccattgatctatatatcactccttataccattaccacacagctttggttaccggtgctttgcaataagttttgaaatcaggaagtatgagttctccaactttgttcttccttttcaagattgttttggccattcggagtcccttgcaattccatataaattttaggatcagtttttttatttcttttttttttttttttgagacagagtctccctctattgcccaggctggagtgcagtggcgtggtcttggctcactgcaacctccatctcccaggttcaagcaattctcctgcctcagcctcccgagtagctgggattacaggcacacaccatccgcccaactaaattttgtatttttagtagagatggggtttcagcatgttggccaggctggtctcgaactcctgacccccaagtgatccgccggcctcggcctcccaaagtgctgggattacagacatgaaagcttttttatttttgaaaaaataaataaataaataaagacataagatgtctttccatttatttagggtctccttgttcttggaggtagattttctctgatctattttcattgagaccttgggccttaagagagccacaatttcatgagagattatttctctggagcccttcctacccttctcctatttcctgtctcctttcctcccttgttattcaaaagtcttaacaaatgctcctgggcccaatacagaggtcagctcacacttccagccttagctttggttcactttttgctttcttgccactggtagttttccctcctctcttaagaacttagctaagcttttcaaaggatgtttgcatttatccaacatttctagattttggtagctggagagttttaataattttctagattgctgttttactagattagaaaaagatagagctgggtgtagtggcacatgcctgtaatcccagctactccagaggctgaagtgggaggattgcttgagcctgggagttagaccaacctgggcaacatagtgagacctatctcaaaaaaaaaagtaagactttagggcgcagtgtaatcccagcacttttggagaccgaggcgggtggatctcgaggtcaggagttcaagacaagcctggccaagattgtgaaaccccgtttctactaaaaatacaaaacttagctgggcagagtggcaggcgcctgtaatcccagctactctggaggctgaagaagagaatcacttgaacccgggtggcagaggtttcagtgagccgagattgcaccactgcactccagcctgggcgatagagtgagactctgtctcaaaaaaaaaaaaaaaaaaaaagacagtgttttttaaagatggagtttagtatacagaaatattgggtgtcaggcaaagtattaattactttgtacgtattctcttttccttcttttttttaaaacgagacagggtgaccaggctaaactctgactgttgggctcaagtgatcctgccttagcctctggagtagctgggcattacaggcacatgccactgtgcccggctacatactcacttataaaactctatttttaaatgacagctcctctttacaaaatagatcaggagagcgattttcctgtctgcttcctgaggaagcaaaaaggcagaaacatggtgagcagcaagaccagtggttgccgtagtaagcatgggacttcctatgaatggctctgttaacagtaggggatggtaatgttctttgatttgtggactctgtttgatttgtggacaaggttttatttcctgtctttggggtaggagggtctgccatatccacaaattggctcttcccatttgttgtattcatttagttagaccatgattggaaagcctcactggctgtgcacattgcaccatacttaggaatatatgacggttatacatttcaaacagggctttaaaaccttccattcagctccttttggataaagctcttttcctcatgtggttgttgacatacatgaattataggctttgtttagctagtgggtaagagcagattttggagtcatgtacacctgggtttgagtttcagtcttgccatgtaccagttgtttgtggacaagttatttattaataactactctgtaccatagtttcttcattggtagtatcttcaaaatgaagtatctatttcctgtgctgttttgaaggtaaccttaaataatgtgcattgtacaatttgatacagtgtctgacacgtagtaaatactttaatatataatacctgtttttattctgatccttgttgagctgctgctttttgatgtgttgattatatataattggtaatcatccattttactgacatcttccaagatttgaccaagttgattgtctcaaatttccaagcagaaaaagtacccagaaaacagaaattaagcagttattaaagaatcgaatagcaatgatcattacgacttgtgcttaataagaaatgtgggccatgtctgcctgagcctttatttaatgcattttaaaatttgctgggttttttcctccctttaaaccttactatcaggttcagtaataagttaaactaaaaagaaacggatgccttagaataaagaaagattcaaattaataggatatataatggcctttcatggtggtggaatttctgtgtgttttgaactaagggaaagacttaaaggaagattgcctacagtgtactggacactttgctaggctctgtggatattatcaagacacagtccttaccctcaaggatctttttatttttcttttagagacgggatcttgccctgccacccaggctggagtgcagtagcaaaatcatagttcactgcaacctccactcactctcaaggatcttactctcagctgggggaggccataaacagttaaagtagcttactctcagctgggggaggccataaacagttaaagagttaatgattgactctagggctaagggaaagaaagtaattgggtcaactaggatttctagcttggcaagggggtagacctggattggcaaactacaacccaatgccagtttttgcatagcccacaaactacaaatgtttcttacatctttgagtggttggaaaaatatcaaaagaagaatactattttgtaacgtggaaattatataaaattaacatttacatgttcataaataaggttttattagaatatagctatgctgaaactacatatctatgactgcttttttgtcacaacagcagagatgagtaattgtgacaaaggctgtttggcctgcagagccaaacatttactgtgtggctctttacagaaaaagtttgctaactcaatgagtaggtggtaatttttatccattgaaacaagcaattaaggaagaacagatacaggagaagataacatttctgtgagtgttgattatttgaatcagaggtacttgtgaatatgcaggtctagaaggcaagggaatttataggtttggagtttggaaagagcttgaggctggaaatggatgtgggaggaaaggaggagatcaagaagactggatggaggagtgcaatttttagccctgtctgcacattggaatcacctgtagtgcttaaaaccaaacaaaaccagacagacatttccaggaacccaaccccaactccctctttcccaagattatgatgcacctgagctggacttgggcaccagaattttttgaaagctcccccagcaactctaatgtgcagccactggtacagagtgagaagattggaagatgggacaccaggaacaccaacatttaagggatagttctaggtgcttctgctgaggagaggaaattctgagggagtgatgatgggaattttagggtggtcagatcctgtaatttgagatcattgttgactgatgaatcaagagcagtttctgtagaggccaggtgagggtgtatgtcagaggcccctggtttgaggtgggagagtatgaactattgagaatattgaccgggaggaaaggggggaaagtgatggctgggatggggggcattgggaatgtagtttgttctagagaggtttttttaagatgttaaagccttgaggctatttatgtgctgagggagtgagtactcagaaagaaagcctggaatggcagtatcagatgccaccattcagttttcatgatggagtgaagggctagattttgaatagttcttggaataatcttaatattgtaacctttttggaactgtttgcttaatgtgctttcttcatttaggtgcattacattgtacctggaaagagaaatggacccaggcattgagaagcaaggccaacaactctgctttgcttgcccggttactgtcgttctgtctgggacattggtctcatctctgaaagcaggagggcaaactgaatgggctctgtagtctcttctaaaagtttttagtttaaactattaatagtacaactttgatttaacaaatgaggaagctgagcttacgagatgtctgtgaagcccattgtctgatcttttatttccttagtacctgggaatgcgcttttttttttttttttttttgaagaacaccaacagttgttcacccttccttgaatttgggtacactgtatatacagagtataccaatttagcctgccattagaacatgtcttcacgagcaaaatctagtataaagtcttactttaatattttctttattatgtataaataatagatggttgttatggaatactggatagtacaaaagtttagaatttttaacattttggtttatttattgggactcttttttccccccagtgattcttgtttctccaacaatgtgaatgcgcactccattcagtgtgaacgtgaatgttaatttatgtgccagctggattctacaggaagcagacacagatggggttggaggggcaaagggcttattagaggagtaatgcctgtgaagaaaaggggaacggaacatgtttgggtatagggagccatcagactgcagtgcacacctgacgaagtctctgcccacccagattgcctgatagaggaataccacaagaggtagaaatggctaggctcttgtactaccactttgcacagtcattgactagagatagatctttgatcaatgtagagattttcagccttggcattgttgacatttgggactggatactttgttatagggggttgtcctgtgatttgtaagatgcttagcagcatcctaggcctctatcccctagatgccagtagcccagcctccctgctattagttgtgacagtcaaaactatctttagacactgccatatgttccctagggaagggcctaatggtatataaacaaccctatggtggcatagtccaagttttgggacagggaggagtgttctatactacccttactggaaagacctatgagctattcagaaatctgaactatttaagatggagctttgttctgtggctcctggaattttaagcacacccctgtgaaacatcttgttaggatatactccactctccaaaacaatccataatgtttaaatagggctgttttattgattgattgattgattgattgagatggagtctcactctgttgcccaggctggagtacactgtcacgatctcggctcactgcaacctccccctcctgggttcaagcaattctcctgcctcagcctcccaagtaactgggattacagacacccaccaccgtgcctggctaatttttgtatttttggtagagacggggtttcaccatgttggccaggctggtctcgaactcctgacttctcaggtgatccgcctgcctcggcctcccaaagtgctgggattataggcatgagccaccgcacctggccttatttttctttttgagatggagtctgactttgtcgcctgagctggagtgcagtggcgcgatctgggctcactgcagcctctgcctcccgggttcaagcaattctacctcagcctcctgaacagctgagattagagatgcgtgccaccatgcccagctaatttttgtatttttagtagatgcaggatttcagcatgttggctaggctggtctcaaactcctgacctcaagtgatccacccacctcggcctcccaaagtgctgggattacaggcatgagccaccgctcctggctattttcttttgagactgggtctcattctgttcccaggctggagtgcagtggcacaatctcagctcactggaaactccaccttctgggctcaagcagtcctcccacctcagcctgctaagtagctgggattataggcatgtgccaccctgcctggctactttttgtggagatgggattttgcatgttgcctaggctgggcttgaattcctaagctagaacaatctgctcagggatgttgtatatttctaaaggtatttttccttttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 948 - DNA, 115464 bp, Homo sapiens
ggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 949 - DNA, 118509 bp, Homo sapiens
tagaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctgtctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccggattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaagacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccggttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcagtctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaagaattctcctgcctcggacttctgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatatatatatatatatatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaactagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctctttccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgagaggctgaggtgaaaagattgtttgagtcgaggaaatggatgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatctattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttactgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacgtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtctgaggaagattgcatatcatcaactaagaattatatcaaggaatgaatagttttccctcaatttatacaatgtttagtttaaataacttgaaataaatctttgattcactttattattttaaaaacaagcgaatgtcaaatcaaacgaggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctacttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacccaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttggcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcgctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacacgtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctaacacttaaaatactttatactatatccaagtattgtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcacttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgtttttctgtatcatataactttttaaaaaaattttattattattttttgagaaagagtctcgctttgtcacccaggctggagtgaagtggcgtgatctcggctcctgcaacctccgcctcccaggttcaagcgattctcctgcctcagcctcccaagaagctgggattacaggcatgcaccaccatgcctggctaatttttgtatttttagtagagacgggggttcaccatgttggccaggctggcctagaactcctgatctcaagtgatctgcccaccttacctcccaaagtgctgggattacaggcgtgagctactgtgccaggcctatattatataactttaaatagtataggagtgatttgttcctgaaaaatttgtcttcattcctttcatgcagagaaattctttaagactcatttatatcttctttcaataggattagtcttttcagatattttactctttttgagtgagtgtgctatatatattttttcaaagaatagtcaacctaaaagaaatattttcttattgtcacatcattgtgtattatacttcattccccactgcttctccagtgcccattaagctccaggtgcactggtttctctataatttctcagaggcacctaggtgttactctttttagccacctccctccacgctcttcccacttcctagaatatgcctctcccactcttcaaatcgtataagttactatggaaaaatataggtgtacatcatattaaaatacaaccttaacgttcaaagtaggagataattattcagtttcgaattctcttcccccaatcttcaaaagatggtttttgttttctttattatacttgccataccttcttattatgcttatttctgtctccactatcatgttttgtgttcactccttcatgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataaaagcttagatatatatttgtcagatttattatatttattattattctcttttaatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattttactatatatccatttgcccttaaaaaaatgtatgtgcattttatgcataattctagtaaacagcttatggttgaatttccttttttaattaaatattagcctattaatagggaattttaactttatgaatattttgatgtattggattttatttcttcatccagtttcattattttaaataattatttaataattgtttaataactataaatatttttattgctaagtgagataagatatctttttgattgtcttttcaaatatatttgacaacatactgacataaccttgaagtttaaagcaaatcagcatacttttattgtatgcatggtatgaaagataatataaatgttttacattgtgatatataatatatatatatatataaattcacattagcaaactaattattttattttttgttactgaaattcaggcctattttcacaatggagactatcctggagaaccctttattttacatcattcaacatcttgtaagttatcactgggctatttattatatatattaagatatatattaatgcttataaagctatattattttacacttataatcacatttgattgttaaatgcttaaataatatctcttccgtaaatgtaatatttttaattgtcagtaaaaccatacatatatatgtaaatatatttaaatacaatatcttaaattcaagttaggagattcaattattaaaggtttgttgaattcataagaggatttatatacccaaactattaaattatgtttatgtttatgaaatatcgtcatgttagtaacatttttcgtgtactattttagattatctattttattctgtctcttcagcatatgtttagcagaagtgggccttagatacaagtctgtcttgatttacttaatggaagctaatataagcactccctaataacaatatacttatgtaaatatttatcactgatatttaaaatattttcatcaaagtaaaggtgtacatgaaaaattacttagaattaaatttcattataataatgaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtactctactttgggctttctctactggttaacattgtaaatagaattatttaagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaactccctgtgttaaatgtcaaaaaagtccagcaagatagctttgattttatttccacattacctttttcttttataatatctttataataaaaatgacttcattgactctttcctattaaattgtaaataatttatagcagtcatagactcagctgaacattcacactcacatcttaataggccagatctgaaacatttcacctggaaagacacagaacaaaaagcacagcatgctagcaagggagcctggcagtgggaatccttgcagcgggaatccttgcagcagtgcacacagcaatccagctacttttcttatgacactctcaaagacaactgagatatgagagaatgagaccacatgtgtaggtgtaggagctgcattccaaaaggaatcagtatctcttatactatttccatgggcatagcttccagacatgccaacaggggtgtgctcagttatgagcgggcactgcactcagggaaacccaaagctggtacttcccatgaggacaatagagttcacatatagcactccctgttcaggtgtagtttagcaatcaagggtcattttgccattagcaatgttgtctggtaaccagctaatattccacttttatcaggtttccaggtcaacggagccaaaaaattagccctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatacaaaaaaaatttttattctgctctggcacttgttcagtgtatcgacttggtataaaattctaagttaaaaattttagaatttaaaaattatttctgtcttattttcctgaatccaattttactttctaattccatcctgattctctctctctctctctctctctctctttttttggtctgttcccaagttttcctcccctggaaatgctaggtttctgtctttattcttggtcttacctgaattttttgtttgttttgttttgtttgtttttgtttttgtttttagagggagtttcgctcttgttgcccaggctggagtgcagtggcataatctcggctcactgcaacttctgcctcctgggttcaagtgattctcctgcttcagcttcctgagtagctgggattacaggcaggcaccaccacacctggctaatttttgtatttttagtagagaagggatttcaccatgttggttaggctagtcttgaactcttgatctcaaatgatccacctgccttggcctcccaaagtgctgggattacaggtgtgatccactgtgcctggccctgaatctttttcattcattttttctggatgctattgacctttgtaacctgaagatttatatatctgagaattctttgctccattttcttcccatagtctttggttgagtctattagtcataaaactcataagttgacttattattttggcattcccctttggtgttgatgttttccttaaaagcttggttcttattggtagtctagtcatagtcacagtgagacaacaggaaaggttgattagatgttctgtggtccttagaagatcttggtgactgaggagatttcctatgatattgctgatttatttttttctgatatcattcattatcaccaaaaactaattaatccccagaaattaatctccagaattaccctactccttgttgtgtggtaaagtgtgaaaaagtggttcttctcacagtaggacaggaagataggtgtccaactattgcatatgtggacaattacattgtcctcctaattttagtcctgtgcctcatcccttccctgtactgagcctgactttattctcagtctctcactgctttcatttaattttccttttgtcttctcctccctggtagtattttttcaagaagatattttttgttattgttgttgttgttgttattgtttttgtaaatagacatttgacttccatgttctgacccatgattcacatttactgcatatgtcactttcaaacctgagactcaggcattctgagtaaatggaatctattcctttgatttaggctgtggcctcctttcttttgttttctaccttctacaacttgttgaaattgctctacttctaatttcccttctctcattttcactgtcattataaatctatggcattttcagttttttaatattagcagggttcctggaaagaagggggaaacacatgtgtgcttagaatgcaagctttatctgaagacttggctattttattaagtttgttgagaaaagtctgatgctgcttaatatttttgtagaacttaatctaattattatggattggaatgctaacttacagtcatttgcagtttcttgcaaaatcttacttcagagtattctagaagttagatgttgcctctgatgaggtttttattcacaaaatctggaaacaatcatgctgattgatatatgtatactagtaatcactggtatggattgacaatttcagtgaaaggaatttcagatagagataagacaaggaacactttgggtcattttaggagcctattgcaataagaacttcttccctaaaaatgttcactgcaatccacctatatattcacattcatgtatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgaatgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcatgctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttattaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaa

SEQ ID NO: 950 - DNA, 118509 bp, Homo sapiens; identical to SEQ ID NO: 949

SEQ ID NO: 951 - DNA, 107145 bp, Homo sapiens
ccacaatgacatgcagacctgcatattggagctggacggagaaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcgtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagatctaagtccgacatgctaagagaacagtgacgtgggtgtccagtctgcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactggtttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacatggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacactggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggaggctgaggcaggagaattgcttgaacctgggaggtggaggttgcagtgagccgagatggggccgctgcactccagcctgggcaacaagagcaaaactccgtctcaaaaaaaagatgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttactttacagtggtccaggattgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccaatctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcacccggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccgtgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaaataaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttattaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtcacccaggctggagtgcagtggcacaatctcagctcactgcaacctccacctcccaggttcaagcgattctcctgcctcagccttctgagtagctgggattgggattacaggcttgcaccaccacgcctggctaatttttgtatttttagtagagacggggtttcaccatgttggccagggtggtcttgaactcctgacgtcaagtgatccacctgcctcagcctcccaaagtgctaggattacaggcatgacccaccatgcccaatctgctttttttctcttaaaatccgtatattaggactggtacggtggctcacacctgtaatcccagcactttgggaggccgaggcgggcagatcacgaggtcagatcaagaccatcctggctaacacggtgaaacctcgtctctactaaaaatacaaaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagatatgcatcttgggagaggggctctgaaaacaagattccagggaatctaccttaaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataattcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatatttcattttttaaaaattatggtaaagtatatataacataaagcttaccattttaactagtgtatatttcaataacattaattatattcatagtgtttataaccattaccaccatgtactttaaaattttttcctcacccgaaacagtaactctaccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctgtcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagatccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcaaggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatatagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtgtgaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcagcctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctccttttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtctgtcctgggtgccttgcatggggatctgttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggcccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacagggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacccctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcaagttgtattgcattaggtcattgaaacctcccaagtgcataggaccctgcctacctttaccaaggaccgcataaaaaaagaggagccccaagcaccttctgggtaggcatggatagccgcccacggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttaccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcgtggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaaccaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttcccggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacatgttatcgtcccggctgagcatgcccgactgccccaactgcaactacaggagaaggtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatggtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcgggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcaacaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctctattttctttcttttttttttttttttttttttttttgagatggagtctccctctgtcacccaggctggagtgcagtggcgcgatctcgcctcactgcaacctctccctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcagtttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataactcccacttggcggtggtatataatccttttcatgtgttcctgagttggtttgctaatattttgttaggatttttgcatctgtgttaatactaataaaatatattggtctgtagtttcctatctttgtgatgtctttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctctaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctgtttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccaatgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattgtgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattaacacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctattcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcattgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggtggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctactttgctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgccgagcccagccagtactttcttataataccttttatgtttttttcttaattttaatttaattttctgctttttagagatatgcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctattctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtagtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcagttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacctagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccaccttcactgccattgcttcatcctttctcatcccctgactaacctactcgtcctccttccgccttctggttcatccacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccacttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtagcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcctcagcgctgctgagggtctcgtgaccacggtcgggtgcccggccttcaattctcgagcagtggtgacagccagacctcagcccccccggtgcacaggggcaggaagaaagtgccacagttgacttaaatctgtgactcacactccttcctctggttactgcattggcgccacgtggcatctctcccctttactagctccttactccccagctgcctcagccactgaggcccagccgttacttcagtcacagggtcaggggcacctgaaaaggggctggtacctactcctcatctctgtcttcctgcggccagagctcctggcagccccacacccagcccctgcatgtgccagaacagcaggctagacttgacatcctgatctgtgcttaggaaggatttctagctgtgtgaccttgggcaagttgcttggcctctctgagcctcagtttcttcatcttcttaggatgggagtaatagtaccaacctcagaaagtaattttaagactttacgtaactttggaaagcacctagcacaggaattggcacatagtaggtgctcaatacaattttttcttagattaaaagctagttgacttagtgtcatcccagtgggatcctgacttcagtagcacccccagtatcaagtgttcagtcatcagcatgtcttttagggtttagctaagtatgattgctgtcagaagccttaattttcctgttcttctttgaagggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggcttgaaggctcactggccctcggggtctgcaggaaggctgggcttactgacttctcgtctttgtaactcatctttgtaactgccttttacttggcctagccagaggcgtaagtgtaattaactgcccaaaaatgctcacacacagagagctgatcccctaggactttgattagaattttagctgttgtgctagattcctctggggcttcgctgcactgtcttgcttttgtctctgtttctgttcttctgtgatttgagttagggtctcactcttgttcgcccaggctggagtgcagcagtgcagtctcagctcattacagcctctgcctcttgggttcaagcgattctcctacctcagcctcccaagtagctgggactataggtgcccaccaccacgcacggctaatttctgtattttttggtagagacggggtttcaccattttggccaggctaggaggtcattgctttctgagcatgtggcaagatttctcagaagctgctttaggaaaatgctgagcagatgtgagctgacagggctgcctgtcacccagcctagggtacagcccctggctgtcacttagggggcccaaaagcaataatgtgatcagagaccaatggcaactcagtagctggctcgaggaggcctcactagccaaagctgggacagattgagcattaaaaggaatgaggaggctgagtgtggtagctcccagcactttgggaggctgagaggggagggttgcttaagcctgggagtttgagactagcctgggcaacatagtgagaccccgtctctaaaaaaaaaaaaaaagttaaaaaaacaggaagtttgactatagcatacaaataaagtcaagaatccataaggattgggatgctcaaacagagcagtagggtgggaagctccttcttctaaaagcacacctcctctaaatgtgtaagaaggataagagtggcaagtcagcatgctgcacccccagggtaacagctggtgcaagtatgcagcattcatggaggttaacaagggatatcagtttggggaatggagtatttctactgttcaaaagcagcacccatagggtactgacagattacagcaggatgatgggcgcttgtgttaatcaattctcacactgctatgaagaaatacccaagactggatgatttataaaggaaagagttttaattgagtcacagttccacatggctagggaggcttcaggaaatttacaatcatggtggaaagcacctcttcacgggggagagaacgagtacacggcgaagggggaagccccttataaaaccatcagctctcgtgagaactcactcactatcactagaacagcatgggggaaaccatccccacgcttcagttgtttccactgggtcccttccaccacatggggggattatgggaacaaaattcaagatgagatttgtgtggggacacaaccaaaccctatcactgggtaccgacagattacaaaggaatggtgggtgccagactctggaggaacctagcagacagtgccatgcacaccaccatgaaacagagagacactgggtgcatcccattgccacaaactcagaaggatccaacgtaatatttgcaggatttgtgcccagaacattttatccaaatctaccaagacaagacaaatccaaattggcagacaggtagcctattaaaaatgttaagtcttgtgaaaagagaaaagggttggaagaggctgggttagtgggaaagctataatggacatgtgaaggaaattggaaaatggaatatgggttataccttagatgagagtatcctgtcagtgttaaatgccagtgaggtgatcatggtattcagcaaaatgtcaaaaaaagagagagggagggagggagggaaagaaagaaaagaaaagagaggagagagaagggaggaaatttttaagtaaaaagctcggtacagtggctcacacctgtagtcccagcactttaggtggccctggtgagaggattgcttgagcccaggggttcaggaccagcctggacaacatagtgagacactgtctcttagaaaaaggtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgtaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcccatctcagcctgtagttttgcagagggaagagcaggggccgtgggccgccatggataggtgggccaactacgcctaaacactgacagcatcgggggtgtgcattgttttttactcattgtataagttgtatttgttatacctagggtggaatcagaggaaaatgaatgaaatgtgtatatagtaaaaacacaatacaacaaacactcaacaggtgtgtttttttgttttttgttttttttctctgagacagagtctcactctgtcgcccaggctgaagtgcagtagtgcgatctcagctcactgcaacctccacctcctgggttcaagcgattcttctgcctcagcctcccaagtagtgagactacaggcatacgccaccatgcctggctaatttttgtatttttagtagagatggggtttcaccatgttggccaggctgatctcgaactcctgacctcaagatccaccttccttggcctcccagagtgctgggagtacagacgtgagccactgcacctggccagactttctttttaagacaaattctgttacctttgaactcgcctgtttgaagctataccccttttcgaagccccttagtatggaagctgtggtggcaggggcagtctcagaaggagtcattggagagactacgtgttcctgttcagtggcgctctgtgagcactttgagggaccgcctgcatgcatgcgcacacgccatgtctcccacgtgagccccttgctgcttgtgtatgactccctagtaaccctgggactatgcaccctctgcgctgcctcttgtctgtgaaatgggcaggacagtgggtggtcatgtgcaacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggaggatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggggctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgctgttccagatgaagaccagcacatggcattgattagaggggaggaaaataagtcttcatgggaagacatgagcagttccctccttaccagagggcatggtgtgtcacaaaaagcaaatgtcaaatacaaaaaacgttagccagtcatggtggtgtacgcctgtagtcccagctactcaggaggctcaggtgggaggatcacttgaacctcagaggtggaggttgcagtgagccgagattatgccactgccctccagcctgggtgacagagtgagactgtctcaaaaaaaaagacaacttttttctcttggaggattgtctaaatgcccctatgctggagcagttccaaagagccttctggtttcagctccctaaaagtgtcaggctccaagaaccagacctcagtgagcagatgtgggctgcatgcagagggaacttgtaggttcctggggttctgacagtaggacagtggtcttgggaagaggccaggtttctgtctgcagcatggtcaggcaaaaaggtgaggaagaggacgatcccacagtggaccagagggtgggcccgatgtcctgtgttgttacttgtatcttagctgttgtgattgttctaccctcaagagctctgctcatacctcgcagtcctacagtagatttagactgactattgggcctgattgggaggctttgggggagaagccttgtcccgtgccccagaagactagagactgctggagtgcagagaacacagtgtgtcctccattcaggagcgtccagcatcggggtacccacgatggtccaaggccctgagacgtcccattgggattcactggaggcctctgggacgccttcctgagttttcagggtactctccaccccaggctcttgccctctgaccttgcaggtggtctgaatccagacttgaggcccagctgaaccttagaggctgatgtcataggccctgcccagcacccagtcccacctcgagggaccacctcctggtgctttctacgctgcacccattttacagagcagctcacagatgtgtgttgaggctcactggctggctggttgttgaagggacagcaatagttgacctatggactctgtcccgtagcaggtccaaaccgggggcctgtgctggggcagccgttctgctggagaccagggcacctgcctttacatgcttgttatttgtccatatattgacaaggcacgtgtgctggatttagatcagctctgagaggatgccaactggccagtgtgtgccagcgagtgtcctgatggagttggtctctcctctgctcccgtgcaggcccacagctcactctagacactggactgcaggacccatccacgaggtggctgctgggtgctgctcctgacatacacatggagaaggatgttaaataatttttacttgaattgtcaaatgaaatttttaataacataccattgttaaatttttatcataatttttaagtttttcaaaagacaagtcaatttgcctgtttaaaatattgtgaaaaataatttacacttggggagtacttttctatttctctaggagaaatgcttttggcagagtttctcataagccccagcatttctaaaggttggtggtgggtggagccgtgctcctaacactgatgactctcatctgctttctgaacacaaagaacagtttccatttgtgcccctggagtttgtgtgcatcactactcaaatgctgtctttacttgggatgaaaattaattttccatcaagttggacagtgagtcatttgctctgtcacatctgtcacactagtgaaaatatatggcacttctgtttatctgctagggtgggaagaaggaatttctagttctttactacacattgctttttgtggtgccatcacagctcattgcagcctcaacctcctggcttcaagcgattctcaaacctcagcttcccaaatagctgggaccacagtcgtgcgccctcacatccagctaattttgatactttttgtagagacggggttttgccatgttgcccaggctgctcttgaactcctaggatcacaggtgtgagccactgcaccagcctggtacacatttcttacattccctgttcaagtgaatgcattagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgctttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattcgtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggtaaatacagaatagcgggaaggtatttctgagcgatgcctggttttccatgtgtgatgtgctagtataggaaaacactgggtttggcatgctctcgccatgtggcctccctcctgtagaaaagagcgtagaggggccaggcatggtggctcacacctgtaatcccagcactttgtgaggccagggtgggcagatcaccagaggttaagagttcgagaccagcttggccaacatgctgaaaccctgtctctactaaaaataacaaaaaaaaattagctgggcttggtggtgcacctgtaatcctagctactcggggaggctgaggcaggagaatcgcttgaacccaggaggcagagattgcagtgagccaagatcatgccgttgcactccagcgtgggtgacagagagactccatctcaaaaaatacatatagagagagagaggatttctaccccctccagttccccaactttagttccccaacatcagtatttcccatgtttgcttcgttattctctctctccctctctctcttatttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatctctttaatttcctttcctttggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctgggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcggccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactcctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataatagtgacttctgggttcttttctacttcatatattctgggaatcactgcacatcagttcgtagagattgtcctcattctttctgcagcgacacggtactccatttaaagtgtacgatgatttctgcagtcactcttctttgtgcgagcgtttaggttgtttctaatgctttggttttttgtttttgtttctgttttaaggtggagtctcactctgtcatctaggctggagtgcaatggcgcaatctcggctcactgcatcctccaccccccaggttgaagcaattctcccacctcagcctcccaagtagctgaaattacaggcacgtgccaccatacccagctaatttttgtatttttaatagagatgaggtttcaccatgttggccagattggccttgaactcctgaccttaagtgacctgcccaccttggcctcccaaagtgctgggattacaggtgtgagccaccgtgcccggactcaatgctttgttttaatcattacacccagtgctacagtaagtacttgtgtgcatatgtgtttccatattgtttggaggtgtttccttggagcactttcccagaagggagagggctgggtcaaaaggtaagtgtgttcccggtgtggtggctcacgcctgtaatcccaacactttgggaagctgaggcaggaggattacctgaggccgggaatttaagaccagcctgggcaatatagcaagaccccatctctactaaaaaaaaaaaaaaaagccacttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcacgcctgttatcccaacatgttgggaggccgagggaggcggatcacgaggtcaggagatggagaccatgctggccaacatgaaaccccgtctctactaaaaatacaaaaatcagttgggcgtggtggcacacgcctataatcccagctactcgggaggttgaggcaggataattgcttgaactggggaggtggaggttgcagtgagccgagatcacaccactgccctccagcctggcaacagagtgagactccatctcaaaaaaaaaaaaaaaaaattaaggctgggcatggtggctcacatccataatcccagcattttgagaggccaagacaggcagatcacttgaggtcagaagttcgaggccagcctgaccaacatgtggaaccctgtctctactaaaaatacaaaaattagtcgggtgtggtggcactcacctatagtctcagctactggagacaccgatgcaggaggatcacctgagcctgggaggcggaggttgcagtgagtcaagatcacgccactgcattccagtctgggcaacagagcaagaccctatctgaaaaaaaaataaaataaaaatttttaaaaaggtaagtgctttcatagtttttttgctagctacgtccaagttctccaaaccctccagtcagcccacccaccagcagcatctgagtgcctgtttggccacagccttgcttatagagtagttgtcaggctttttaactgttgccaatccgttagctacagtaagccctcagtgtagttttcatttgcatttttctcctctaattacaatgaggtcaatatattattaagggctatttctttttgtgtgtatgaattttctattcatacctatttctcatttcttactaggtttttggtcttttcccttttgtatttaagaattttgtttttgtttttgagacggaatcttgctctgtcgcccaggctggagtgcagtggcgcgatctcggctcactgcaagctccgcctccgggggtcacgccattctcctgcttcaacctcctgagtagctgggattacaggtgcccactaccacgcccggctaatttttatatctttagtagagacggggtttcaccgtgttagccgggatggtctcaatctcctgacctcacaatccgcctgtcttggcctcccaaagtgctgggattacaggcatgagccaccgcacccagccaagaatttttttatatggtagggacattagccttttactcatgcagtatgctgcagacattctctcccagttcataagttgtcttttgactttgtgtatgcttttcagtcaggtggaaatgttcttccttttatgcggtcagcttcttgattttttattgcctctggattttgaataattgttagaaagctttacgctaacattgtgattaaagaggaacacacccatgctgccttccagtgtttgtgtagtttctttttttttcatttatatccctaatatgtttggaaatttttcttctctgtggtgtgaaatatggatccaatttctctttttccaaatggttagcgagtggtcccagcacattattattatttattcttttttttgggaagtggggtatagggtcttgctctgtcacccaggctagagtgtggtggtgcggtcatagctcactgcagcctggaactcctgggctcaagtgattctcccgcctcagcctcctgagtagctgggactacaggcacgtgccaccatgctggctaatttttttttttttagtagaaacagggtcttgctacattgccttagctggctataactcctgggctaaagcagtcctcctgcctcagcctcccacagtgctgggatcacagacgtgagctaccatgcccggccttagcaccagttattagaaagttcatcctggaccaggtgtgagggtgatggctcatgcctgtgatcccagcactttgggaggccaaagcaggaggatcattcgagcccaggagtttgagactagcctgggcaacatagtgagaccccatctctacagatattttttttaaaatagcagggcatggtggtgcacaccagtagtctcagccacttggaaggctgaggcaggaggatcacttgagcccaggtgtttgagattacaatgagctataattgtgccattgcactctagactggtctataatgagaccttgtttctacaaaaacaaaaataaataaataaaatcatcttgtcccagtgattcaagatgccacctttgtcctacaataaatttctttctttcttttttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttatatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgtttttccatttgttcaagtttactttcaggtcattcaggaatattttaaattttctcttaaatatttttcacatttcttactgagtgtatttctcagcatttaatcaccattgtttttaatttaaatgggatcttctccaccattatattttataattctgaactatccaatacagtagccattagttatatgtcattatcgagcacttgaaatgtggccagtccaaattgagaagtgttataagtgtaaaatatatactggattttgaaaacctagtgtaaataaaagaatgcaaaatatctcagtataatttttaatattggttacatgtttaaatcataatattttggatatattaaatatattactgcaattaatttcacccgtttctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaattccacctcctgggttcaagcagttctcatgccccaccctcccgagtagctggaattacaggtgccgcaccagcacactcaactaatttttgtatttttagtagagaccaggttttactatgttggccaggctagtctcgaactcctgacttcaagtgatcctcctgccttagcctcccaaagtgctgggattacaggcgtgagccactgtgcccagcctcagattgtatttctattggatagtgctgccctaactggttatttatttgtgtatgaaagctattgatttttgtttgtttgtttgtttatttcgagatggagtttcgctcttgttgcccagtctggggtacaatggtgcaatcttggctcactgcaaccttcgcctcccaggttcaagcgattgtgctgcctcagcctcccaagtagttggaattacaggcaagcaaaaccatgcccagctaattttttgtatttagtagagatagagtttcaccatgttggtcaagttggtctacaactcctgacctcaggtgatccacccatctcggcctcccaaaatgctggaattacaggcgtgagccaccacgcccggctgtatgttaactttatttttttattttttattttttttaatttttatctattttttgagatggagtttcattcttgtcgcccaggctggagtgcagtggcgcgatcttggatcactgcagcctacgccttctgggttcaagcgattttcctgcctcggcctcccaagtagctgggattacaggcgcacaccaccatgcccagctagtttttgtatttttggtagaggtggggtttcaccatgttggctaggctggtctcgaactccagacctcaagtgatctgccctccttggcctcccaaagtgctggaattaacaggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgtcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttgaattcctggaataaagctcacttgattatggtatatccttttgttttggaatctgtttacattatttaatatatttacatctatattatttttaggagagatgggtctgtgacttccgtttttgttctgtctgtattagctttgagtatcaatattatacttgcctcataaaaagaattaggaagtttttggctgggcacggtggctcatgcctataatcccagcattttggaaagccgaggaggggtgcggatcacgaggtcaggcgttcgagacaagcctggccaacatggtgaaaccccgtctctactaaaaatacaaaaatttgccaggcgtagtaacacgcacctgtaatctcagctactcaagaggctgaggcaggagaatagcttgaacccgggaggtggaggttgcagtgagccgagaacacgccactgcactccagcctgggacagagagactccacctcaaaaacaaaacaaaacaaaacaaaacacaggaaattttcttgttttttacattttcagtgatctggaacaattcacattgggaccatccaggctttaaaggtttgatagaaatccctttgcaagccccctggacctggtgtgttttctgtggtccttgctagcagtcttctctcctctctggaaattattctatctctagtgaggttaattttggtaaaccatctttctgtagtaaattattcttttcaactagattttcaaatttatttgcatagatgtctgcaaggtagtctagtcatagttttaaatttctttgcaatgattattttcgcctgtcatttcttagtttgtgtatttttcctttctccctattttgcttaagttaatagtttatgtattttgttagttttttaaaatcatctgagtttattatttaggtttactgttcttcttttgtttttttttttttttctttttttttttttttgagacagagtctcgctctgtcccccaggctggcgtgcagtggcgtgttctcggctcactgcagcctccacctcccgggttcaagctattctcctgcctcagcctcccgagtagctgagattataggcgcgtgttactacgcctggctaatttttgtatatttagtagagatggggtttcaccatgttagccaggatggtctccatctcctgacctcatgatccacccgccttggcctcccaaagtgctgggattacaggtgggagccactgtgcctagcttactgtttttctttacctcctttctttcttttttattttttattttaagacagagtctcactcatgttgcccaggctggagtgcagtggcacactcacagctcactgcaacctcaacttccctgggctcgggtgatcctccccactcaccttctcaagtaggtggtaccacaggtgggcaccaccacactcggctaatttttttgtagtttttgtaggaacagcattttgccagattgtccaggctggtctcaaactcctggtctcaagccatctgcccacctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcatgccattctcctgactcagcctcccaagtagctgggactacaggcgcccaccacctcgcccggctaattttttgtattttttagtagagacggggtttcaccatgttagccaggatggtctcgatctcctgaccttgtgatccacccaccttggcctcccaaagtgctgggattacaggcgtgagccaccacgcccggccactgtgctttcttttgttttactttcttggggttttttctaactttttaatttagaaattcagttcattttgttttttcttccatttttattgataaaagtgttcagcacgtggaactttcctctgatctttttcttaacaatatcccatggaatctgatagataatttttccttttttgtttgtttgtttgtttgttttgtttttgagatggagtctctctctgtcgcccagattggagtgcagtggcatgatctcggctcactgccacctctgcctcctgggttcaagcaattctcctgtctcagcctcccgagtagctgggattacaggcatgcaccaccacgcctggctaatttttgtatttttagtagcgacggagtttcaccatcttggccaggctggtcttgaactcctgacctcaggtgatccacccgcctctgcctcccaaagtgctgggattactggcgtgagccaccacgccgagcctccattattttttttaaagaaattctgggctgggcgctatggctcatgcctgtaatcccagcactttgggaggccgaggcgggcagatcacttgaggtcaggagttcggaaaccctgtatctactaaaaatacaaaaattagctggacgtggtggcacgtgcctgtagtcccagctactgtggaggctgaggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtatgtatttacatatggagatacatatatgtatacacctccatgatacattaattctgttgtttagtcttctgtatatccttattttgtgtcctcatggcctgtcttctgtggcttattattaatatgtttctgtgttttcttgcatctcctgtttccgtgttgtttggtgcacattcctgttatatatttttagttacttgtggctttttgtgttgagaagcggccaccttctggtcgtgctttgtgcctgcggcctaagtcctgctctgtctgcgttgtgactgctgcccctgctctccttcggcccatttgcctgacgagacagccttgtccttggccctttgtttccagcctttttctgagtgccttggttttaggacgttctcttgtgtgaagcaaacctgaggcttgctttgtgagccaaattgaaaatcttcttttcagtcagttaagcccattcacacttagtgatataactatgtggttggtctcaaccctgtcattattttataatttctgtattttctatttactgttttgttttttgggtttttttaaaatgtgttgtggggttttttgcttttttatttaaaaaaaaaattgtggggctgggcgtggtggctcatgcctgtaatcccagcactttgggaggctgaggcaggcagatcacctgaggtcaagagttcaagaccagcctggccaagatggtgaaaccccatctctactaaaaaatacaaaaattagcccaggtgtggtggtgcatacctgtagtcctagctacttgggaggctgaggcaggagaattgcttgaacctgggaggtggaggttgcagcgagctgagattgtgccactgcactccagcctgggcgacagagctagactctgcttcaaaaaaaaaaaaaaaaaattgtccaggtgctgtggctcacgcctgtaatctcagcactttgggaggccgaggggggcagatcatgaggtcaagagatcaagaccatcctggccaacatggtgaaaaccctgtctctactaaaaatacaaaagttagccaggcgtggtggcgcgcacctgtagtcccagctactcgggaggctgaggcaggagaattgcttgaacccaggaggtggaggttgcagtgagctgagatcgtgccactgcactccagcctggcaatagagcgagactccttatcagaaaacaaaaaaaaattggggtattaggaaaatgggtgcttttttcctagtgcattcctatagacttgcataccccactcatgctccttgggcctgggttccctgtgtaccccctcgtggcctgctgtgttggcattagggggtcctctgacacccactcattgcctccacagcaggcagtgagtgaattccattctttgtgttttctctttcctgtctccctgtctctcctcttcccattttttgttggtggtgtttctgctctgtcagaacacacggtattcttaggtacacaatttactacaacagggctcccgcttgcctctgctgagtgttcccaggtgtcttcaggttggtgaagctcatcctcaggcagtggccttgagtagggccacagaattctctgagttctggagaagtaaactttgacctgttgtgttgtcaatgaacagatagtttggttggatataaaatccttggatcaactgatttctcctgtttaatatagtgtggttgttgtaaaaaaattttttcctgataccaaattggttaaagttgtgtttcctgtttttcttacaccaagattttatagactgattattctagttctagtcaggaaaagagagtattagaaatctattatgacagcacttccagcagacatgccagctctttttcctcctcaagttggagctcttttcttctagaacttcttgtgggcggctgctgacatcatgctttcttagatcttcactttttgtacatctgtaaatgctccggccctctctcacccttgcttgtgcatcagtttcctgcatcagcagacggtgttctgtgcttcctttctgctgcttgagtttttaaaaatcgagactcagaatgctttcccatgccctgaagcacctctctgtacaaacatgtggagcctgctgtggctgggggctgtcctcactctccagtcacatccgctattctgtgccaggattgagctattggctgcgtttcctttaacctaatctttcccttcctcctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacacacttgaaagcacttgcctggtgctgtgtgagttgtcaaaaatattagctgctattatgcgagtaaaacgtgcctcatgctaccatggaaattccccagtggtagaaagaaatggagtgtttattaaaggttctgaaaaattgtcccgtgttgagggctgcagggaaatggagactcacctttaacaaagaaatgtcagtggctcctgtcctctttgttcacatcgatgaggctgaatgctgtgtgcactgcacccccccaaccccgccccagcccagatgtgtgctgctggaccctctttgatacttaaggctcacataagcctccgggaatgtattcacgattgaattagataagtgaccagaacagaacagagaagtagaaattctcaaacttgcctgagagtctaggaaattgagtaattctcaatcaatgatttccctgctatcctgcctgttttcaaagatggttgtgtaattgcagcatgaaatgtagccttggtttttgtttggaacaacttgaaagtgtttggccaggcacagtggctcacgcttgtaatcccagcactttgggaggccgaggtgggtggatcatttgaacccaggaattcaagaccagcctgggcaacatggtgaaaccctgtctctaccaaaaatataaaaattacacaggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatgggtgagatgaatgcctgggagaaccaccttcctgtagggttgatgtctgggtcctcttcctgtcaagggcacattcgagggacagccctttccttaacatgggcctgtcccctgggcagcttctgctggcagctgtgctctgcctgactccaacggagacttagggcagtccctgggcttgcgtgcgaattagatttctgggaatcttcttgctaaagggctctctgatgggctgcctgtcatataatgaccagtcacatggggagtctaggttctggcaaacatgtcttctaacgggacctgaagccacagttgctttgcttagtggacatgtgagttctgcagtttccaggtcagacctgggtgttcataagcacaccaaagagatctgtcctctaaaatctcattttagaaaaaatgtttacaatttttgaagttgtttaaattgagcgaagacaaatgatttcttccgttctgataagatagcctgctgctgtaatttgacttgctgcttctcttttgttttacagatgatgtctttctacctaaagatattgacctagacagtgtggatatggatgagacagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccctacttagacctgtcggatcagattctgggaaggggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagtgcagtggcacgatctcagctcactgcaacctctgcctcccgggttcaagcaattctcctgcctcagcctccagactagctgggattacaggcgcccacaaccacaccaagctgatttttgtatttcagtagagacagggtttcaccgtggttaccagactggtctcaaactcctgacctcaggtgatacacctgccttagcctcccaaagtgctgtgattacaggcgtgagccaccgcgcccagcctatttatttcattttttttattttttgagacagagtctctgtcacccaggctagagtgcaatgttgtgatctgggctcactgcaatccccacctcctacgttcaagcgattctcctgcctcagcctcctgactaactaggattacaggggcctgccaccacgcctggctaatttttgtatttttggtggaaacagggttttgctatgttggccaggcaggtctcaaactcttgactttaagtgatgcactcacctcagcctcccaaagtgctgagattacaggtgtgattaagcgtgcatttgtattataataaaaacaacaaaactggactagaggctgcgcctggtggctcacacctgtaatcccaacactttgggaggccaagacaggcagatcacttgatcaggtcaggagttcgagacgagcctggccaacatggtgaaaccccgtctctactaaaaatacaaaaattacctggacgtggtgacaagagcctgtaatcccagctactcaggaggctgaggcaggagaattgcttgaacctgggaggcacaggttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggagtttgaggttgcagtgaactatgatcacggcacttgcactctagcctgggcaacagagcaagaccctgtctgaaaaaaaaaaaaaaaaaattccccgagtagctgggattacaggcgcctgccaccacgcccagctaatttttttatttttagtagagacgaggtttcaccatgttggccaggctaatcttgaactcctgacctcaggtgatccacccccccttggcctcccaaagtcctgggattacaggtgtgaaccaccacgcccagactgtcaaaatttttaaatacacagaactaaaaagataattaaaacattgcatatgaaaacctgcgggatatcgaaaaacgttaactttttagagctgtttatgtaaggctataattgcctaaattagtttttaaaaatcctgaaacataatgagttaaagatttcacttgagaaattaggaaaagaacaatagaataaaccaaagaatatataaagaaggagataagagagataatgaaatagaaaacaaagatttggtagagaagatcaacaaagctaaaatatgattgattgaaaacaccaaataaatctttaggagacagattaagaataatagagaaaaaaagacacaaaaaatagcataattagatggaagaagaattaagatgttgataactatcaaagtcaggtgatggctatgttcattatgctatactatctgtttttgtgtgtgtttgaaaatgtcagtaattaaaaaaaaaaaaagttttgtccgggtgctgtggttcatgcctgtagtcccagcacttcgggaagccaagacaggcggatcacttgaggtcagttcaagaccagcctgggcaacatggtgaaatcctgtctctacaaaaaatacaaaaaaagtaagccagatatggtggcatgcgcctgtagtcccagctactcaggaggctgaggtgggaggatgggttgagcctgagaggtggaggttgcagtgagccaagattgtgcatctaccctccaacctgggtgacgagagccctgtctcaaaaataaatttttttttttaagtgtgtaaatatataagtgaaaaggaggaaataactacagatactggagagattaaaataagagaacactgggaacaacttcattacaattgactttaaaactatgaaatgcaaaatcaacctgaggtaaaaatagcctgaatggtccagtaactactaaagaaatgaaaacaatagctgtaagtctcagtgagaaaactacattttaacagttttaccgagaattctaccaaactttcagactttgaaagaatggattatccagtcttgagcaaactctaccagtgaatttaaatgagtgagacatcacacacacaagtgaatactccctactttgttttatgagacaagtaaaattctgataccaaaatctgcccaaaacaataccagaaaaaatgaaaaatcacaggtttatctcactcatattagattcaaaaatcctaaagaaaatattctccaggaggctgaggcaggagaattgcttgaacccaggaggcagaggttgcggtgagttgagatcacgccattgaactccaatctgggcaactagagcaagactccgtctcaaaaatattctcatacctacatcagtgtaattttcaaaaaaaagaaacaatataccaaatcgagcagtgtattttaaaaagcagtataccatgagcaaattggtttatcccaggaacgcaaatagtgtttcatattagaaaatccactttattggccaagcgtggtggctcacgcctgtaatcccagaactttgggaggcccaggcgggcggatcacctgaggttgggagtttgagatcagcctgaccaacatggagaaaccccatctctactaaaaatacaaaattagccaggcatcgtagcgcatgcctgtaatcccagctactcgggaggctaaggcaggagaatcacttgaacctgggaggcggaggttgtggtgagccaagattgcaccattgtactccagcctgggcaacagagagacactctcaaaaaaaaaaaaaaaaaatcctccttccttcctccctccctccctccctccctcccttccttccttctgacagggtctcactcttgtcacctaggcttgagtgccatgacacaatcactgttcactgcagccttgacctccccagggtcaagcagtcctcccacctcagccctccaagtagccgggactacaggcacatgcaccatgcctggctaattttttttttcttctttttgtagagacggggtttcgccacattgcccaggctggtctcgaactcctggcctcaagtgatctgcccacctcagcctcccaaagcgccagaattacaggtgtgagcccccgcacccagctagaaaatccactaatgttagttgctacattaatatattaaagaagagccatatgatcatggcttagtagatcatggatcagtagatttccaaaaaaagtattttatattcaaccttaaattgtaattcctaggctaaaggagtataaaagaggaactaaaaatcaattttacaggtgatctaattgtctacataggaaatataaaagaacttacagcaaggggctaactgtgtaggatcagtacagaagttatttgcttttgttttttgtttttaaacagagcacggtggctcacacctgtaatttcaacattttgtgaggctgaggtggaaggatcacttgagcccaggagtttgagaccagcctgagcaacatagcaagatactgtctctacaaaaaataaaataattagccaggtgtggtgacatgcacctgtggtcccagctactcaggaggctgaagtggcaggatcccttaaacccaggagaccaaggctacagtgagccaagatgcaccactgtgctccagcttgggcaacagtgagactctgtctaaaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaaaaaaaaaaaaaaaaaaaaaaaaaaaaagccaggcatggtggtacatgcctgtagtcccagctactcaggaaattgacacaggagtatcccttgagctcaggagtttgaagcttcagtgagctatgcttacgccacctcactccagcctaagcaatagagagatcctttctccaaaaaaattaaaacaaaaggcaaaccattaggattacacagcaagcttttgaccactaaactacaaagaggtcttcagcctgaccaaggagccccatggcaagaccagaggaggtgctgctgcttcatgggtttgcagctagcgagccctccctctctcctgctggaggaaggtgtgaagcgacgggagtccctaaccactgctccggggagcataactgttaaattactttggaaaagagtttggcagactctagcaaaattgaagttgtgcctcccgtgcaaccccacaaacagctgcacacttgtgtgcacgactagaggttctcctgcatgtcccgggggcggggcaaacgtgaggcaagcagcagcatctgtctgttcactgccatgtgttcataccgcagtgaagacgaacagactgtcacctcatggagaactctcacagacataacattgagtgaaataagaagctgtaagaccatgtacatacagtgcagttccctcgatatgaggccacacagcacaaccatactaacatttaggatgtcatagagaagtcacgaaattaccaagaactatggtgaactaattactccaaaccctagggctgtgactacctcttgggagaggacagcacggcgccacggttagcagtgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgcctgtaatcccactttgggaggccaaggcgggtggatcatgaggtcaggagttcaagaccattctggccaaagatgttgaaaccccctctctactgaaaatacaaaaattagcaagatgtggtggtgggtgcctgtaatcccagctgctcgggaggctgaggcagagatttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatcacaaaagaagttattcatttaaccaaactaataattcaaaggtttcaaaaagcaaaaacctttatgttttgataggagactctggttttggagggttggggtttctgggttttttgtttgtttgttttgttttgtttttttgagacagggtctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgagatggagttttgctcttgtcacccagactggagtgcaattggtgcaatctcggctcactgcaacctccgccttccagattcaagtgattctcctgcctcagcttcctgagtagcctctattacaggcacccaccaccatgcccagctaatttttttgtgtttttagtagagacagagtttcaccatgttggccaggctggcctctaactcctgagctcaggtaatccacctacctccgcctcccaaagtgctgggattacaggcgtgagccaccacacctggccctgtctctattttttaattaaattaaaaactatatatatatgtatgtatatacacacacatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctgtagttcaacagtttatagccaatcactatcaatataatttctgtaaagcaatgagaattcttgacaactttttttttttttttaaggcaatagtcttgctctgtcacccaggccggagtgcagtggtatgatcttggctcactggacccttgacctcccaggctcacttgatcctcccacctcagcctcctgactagctgggactacaggcgtgggccaccaatctcagctaatttttatttttatttttattttattattattattttttgagatggagtctcgctctggcgcccaggctggagtgcagtggcgcgatttcggctcactgcaagctccgcctcccaagttcacgccattctcctgcctcaggctcctgagtagctgcgactacaggcgcccgccaccacgcctggcaattttttttgtatttttagtagagacggggtttcaccgtgttagccaggatggtctcgatctcccgacctcgtgatccgcccatctcagcctcccaaagtactgggattacaggcgtgagccaccacgcccagcctcagctaatttttaaaatgtttagtagagacagttctcattatgttgtccagggtggtctcaaactcctggattcaagtgatctatctgcctcggccttccaaacgttgggattagaggcgtgagccaccaagcctggccctgataaacaacttttgtaatcacctcctctcctaatttgttctttttttcttaaaaacttgagttgttctttctaacccccttccctttctaaagaggcaagagatttgggtttcagggaaaaaaaagggaaactgccttctctggccttgcttcacagcatgggatccgggtcccggtactggcagtttggctccgttcctcctgtggcttctttttttttggcctaaattacacagcatgcttttaaaattgctgcttcctactgtttgtaattcagaccttttttcctccttaaatttgtgaccaaggccaggtacagtggctcatgcctgtaatcccaatactttgggaagccgaggcgggtggatcacttgagggtcaggggtttgagaccatcctggccgacatggtgaaaccccacctttactaaaaataccaaaaaaaaaaaaaaaaaaaaaaaaagccgggtgtggtggtgcacatctgtagtcccagctactctggagtctgaggcaggagaatctcttgaacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggccaacatggtgaaaccccgtttctactaaaagtacaaaaattagctgggcgtggtggtgctcgcctgtagtcctagctactctggaggctgaggcaggagaatcgcttgaaccccggaggcggaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaaaaaaaaaaattattttatttattttttttttgagatggagttttgctctagttgcccaggcacgatcttggctcaccgcaacctccgcctgccgggttcaagcgatgctcctgcctcagcatcctgggtagctgggattacaggcatgcgtcaccacgcctggctaattttgtatttttagtagaggcagggtttctccatgttggtcaggctggtctcgaactcccgacctcgggtgatctgcccaccttacctcggcctcccaaagtgctgggattacaggcgtgagctgccacacccggcccaatttttttttttttttttttttttttggtagagaaggcatctctttatgttgcccaggctggcctctgagtatctttccacctcagtcttccaaagtactaggattacaagcatgaactacctccccagcccaaccccacaggtttaccttccctcatttttggcactagtcccatgggcagtttcgtttttctattttcctgtctctttaaatcttccacctggcatttgtgcatagactgtcagctgagaagctgagaccttagaaaatatggcctgacagatgtggcttgcaccctattcgcagctagcaagactttctttaagctgttcttgagaggggcctggggctgaaattttgttccctcttcagagaccttggttaaagccataaagggattcttaattttggtctcatgcatgtctgtgtgtgttggctttgagtcgtttgtgcaggtatgcccttgaatgattataaatttctggtttatatttagaatatgataggggttttttgttgttttgtttagccttctcctaagctaaatgaaaccatatactcagaaagtaaacagtttattaaaacattcaaagacaaacagctttaaatagtggttaccctagacctctaataagcaaatatgttccacctccaaaacttttttttttttttttttttttttttggtgggagcacaaagtctggttctgtccgtccaggccgtagtgcagtggcgcattctcagtttgttacagtgggtagctagtcaggtgtgagcagggcaggggagggcctcctccatccaccagggatgtcaggtgaccatcaggtgatggttaggcagttgtcacactgcctctctaaaataataattggtcatagccagcaccagggaaactgaagctggtgatcagcagcttcccgataagatctcaggaattgggcaagtgggctcaagcatgtgcactaaggcacagaatggtggagtttaactggtgtgtgaccttccaggtactttacaccgggaagggaagatcgcctcaggtgagcatgcgcatgctccagtaaacacactacgcatgctccctcccaagtgctagcaggccagtgtgtgtgcaggcagcccaccccaagggaggaattgggagaagggacgcgaggccctgaagtatgccaacacctagaaccctacatcagaggccggatggggcacttgcctctcgagttgcccacttggcctcttccaagtgcactttccttccttttgtttctgctctagagctttgtaatgaacttccactcctgttctaaaacttgcctcagtctcttcttctgccttatggcctttggtcagattctttcgtctgaggaggcaataattgaggctgctgcagacacatacggattcgccaccggcaactcaggtacctgccaccggcaacaggctcgctcagcctctgcccaccaggctgaagccatgctcccaccacagcctcccgagtagctaggaccacaggtgtgcgccaccacacctggctaatttttgtgtttttttgtagagatgaggttttaccatgttgcccaggctggccttgaacttgtaagctcaagtgatccacgcacctcagcctcccaaagtgctgggattataggcatgagccaccacagcaaggctttattatttttgagacgggtctcacctttgtcacccaggctggagtgcgggggcaccatcacagctcactgcagccttgacctcccaggctcaaggatcctcccacctcagccccgagcagctgggactataggcacatatgtgtactgccactcctggctaactttttactttttgtaaagatggagtctcactgtgttgcacgggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgcggtggctcacgactgtaatcccagcattttgcgaggccgaggagggcagatcacaaggtcaggatattgagagcatcctggctaacatggtgaaaccccatctctactaaaaatagaagaaattagctgggcgtggtgataggtgcctgtagtcccagctacttgggaggctgaggcaggagaatggcatgaacctgggaggcgaaggttgcagtgaaccgagatcacgccactgcactccagcctgggcgacagagcaagactccgtgtcaagaaaaaaaaaaaagcttcttggccagggaagaagctacaaaaaatacaaaaattagctgggtgttgtggtatgcacctgtagtcctaactatttgggaagctgaggcaggagaatcgcttgaacctgggaggcagaggttgcagtgagccaagatcgtgccactgcactccagcctgggtgacagagactccatttgaaaaaaattaaaaattagctaggtgtggccaggcacagtggctcacgcctgtaatcccagcactttgggaggccgaggcaggcggatcactttaggtcaggagtacagatcagcctggtcaacatggtgaaaccctctttctactaaaaatacaaaaatcagctggacgtggtggtgggcacctgtaatcccagctacttgggaggctgaggcaggagaatcacttcaacgtgggaggcggaggcttcagtgagctgagattgtgccattgcactctagcctggatgacaagagcgaaactccttctcaaaaaaaaaaaaaaaaaaaaaaaaaaaaccggtgtggtggtacatgcctgtagtcctagctacttgggaggctgaggcagagaattgcttgaaccttggaggtggaggttgcagtgagccgaaactgccactgaactccagcctgggcaagagagtgagaccctgtctcaaaaaaaaaaggatttcaccatgttgcccaggctggtctcgaactcctaagttgaagtgatttgccctcctcagcctcccaaagtgctgggattacaggtatgagccaccacaccctgcctgggcctgataatttaagggcgctcacagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagtacagcaggaga

SEQ ID NO: 952 - DNA, 107145 bp, Homo sapiens; identical to SEQ ID NO: 951

SEQ ID NO: 953 - DNA, 107145 bp, Homo sapiens; identical to SEQ ID NO: 951

SEQ ID NO: 954 - DNA, 107145 bp, Homo sapiens; identical to SEQ ID NO: 951

SEQ ID NO: 955 - DNA, 107145 bp, Homo sapiens; identical to SEQ ID NO: 951

SEQ ID NO: 956 - DNA, 107145 bp, Homo sapiens; identical to SEQ ID NO: 951

SEQ ID NO: 957 - DNA, 46793 bp, Homo sapiens
caatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactgccgtccgcgcgggcgcaccgagcccggcttggcgcgggcaacagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgcctttttttttttgcaaggtgaaggtttatagcaaggattcatcgagcaagtctgtaaatgccagccatttttccaacagcatgtgctcactttgtgtctcttgtgtcacgtttgggtaattcacaatatttcacactttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtgaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacagtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaaattagccggtcttggcagcgggcacctgtagtcccagctactcgggaggctgaggcaggagaatggtgtgaacccgggaagaggagcttgcagtgagccaagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagtttgagaccagcctgcccaacatggtgaaaccccgtctctaccaacaaaatacaaaaattagccaggcatggtggcacgctcctgtagtcccagctacttgaggagctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgagcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcagggtttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcattagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtaactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggctgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatccccccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctaggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcccgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttatttatttttttgagatggagttttgctctcgttgtccagggtggagtgtaatggcatgatctcggctcctctgcctcccaggttcaagagattctcctgcctcagcctcccaagtagctggaattacaggcatccaccaccactccaggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcacctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgataggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtggcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccacgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaattcaattttttttagcaaggccatatttatactttctgcagaaagggtacactcaccagttgttttgccatgagaatacattgaataaaggagacagggttatttataacttgatgtgtttactctgctgctgtatccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttgggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgaggcagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacaaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgtcactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattggtgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtacctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccatgttagccaggatggtctcgatctcctgacctcgtgatccgcccgcctcggcctcccaaagtgctgggattataggtgtgagccaccgcgcccggccttgggtcatgatttccatcatcttagacctgttggtgctgaggttttctttaaccattggtagtctagacatcaacatgagcttcaatcatggtctgccttttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacagacatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggcctttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaata

SEQ ID NO: 958 - DNA, 46408 bp, Homo sapiens
cagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgcctttttttttttgcaaggtgaaggtttatagcaaggattcatcgagcaagtctgtaaatgccagccatttttccaacagcatgtgctcactttgtgtctcttgtgtcacgtttgggtaattcacaatatttcacactttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtgaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacagtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaaattagccggtcttggcagcgggcacctgtagtcccagctactcgggaggctgaggcaggagaatggtgtgaacccgggaagaggagcttgcagtgagccaagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagtttgagaccagcctgcccaacatggtgaaaccccgtctctaccaacaaaatacaaaaattagccaggcatggtggcacgctcctgtagtcccagctacttgaggagctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgagcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcagggtttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcattagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtaactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggctgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatccccccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctaggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcccgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttatttatttttttgagatggagttttgctctcgttgtccagggtggagtgtaatggcatgatctcggctcctctgcctcccaggttcaagagattctcctgcctcagcctcccaagtagctggaattacaggcatccaccaccactccaggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcacctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgataggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtggcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccacgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaattcaattttttttagcaaggccatatttatactttctgcagaaagggtacactcaccagttgttttgccatgagaatacattgaataaaggagacagggttatttataacttgatgtgtttactctgctgctgtatccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttgggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgaggcagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacaaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgtcactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattggtgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtacctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccatgttagccaggatggtctcgatctcctgacctcgtgatccgcccgcctcggcctcccaaagtgctgggattataggtgtgagccaccgcgcccggccttgggtcatgatttccatcatcttagacctgttggtgctgaggttttctttaaccattggtagtctagacatcaacatgagcttcaatcatggtctgccttttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacagacatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggcctttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaata

SEQ ID NO: 959 - DNA, 46793 bp, Homo sapiens; identical to SEQ ID NO: 957

SEQ ID NO: 960 - DNA, 162111 bp, Homo sapiens
tttatcttttaaaaatacactttaatctaaccatggaatttcacaaacatttatatacaatcagagactaatttgaagtatgttttccattcatttcagccatgagaaaacacattgcagtaaaaattaaagatacccatccataaattacttttatttctcattaaatgagcacagagtcattagtatattaataacagatatgtttattattacatatccatcagtgcggctttcaataccacttgaaacatgcatatcatcctagagacgatcggttttccagtgcttcttatctgatacacattactgcaaagccattataaattactgaggaggtatttggttaaaaaaataaacaataaatcatactgtccatatgaatcaactcttgttactggacaagagtttaacagtatttatctggtaattcctatgttaactggaaaacatcatggatgtattgccatatttcctttttatgttggtgcaaccttctacattttttgcagttttataaagtcattattgtagcaggtagtttgatgcaaagattgtactcaatttatgaaagtccaacaaacctctaaatattttaaattaaaccaattatcaatgaaaaactcactgacacacataattttttgaaaatacattttttgaaatttctatacttactcatggcagtaaaataattatctcaaattaaggcactaaaaggacaatgcaacccccattgaaagtgttctaagaataatttacatttcaaacagtgcatacatttcttatatgtttgttaacttaatgtctttatcatttaaaaccacaaagaaatacattatacaattatagaaatgatgtaccccacaaaatgcttttaaacttggttcttttgtacagttagtttcctaatgtctctagtagtaaaataactcaatatggcttggcaaaaatgcatagattaaatgtaacttttttttgtcctctcccattccccaaacttgctgaaacatatacagtattttgtaaagcataatgaaagatatttaatttctccatcaagtccaacatgggcaatcaacagtaaggcttttaaattctacagtgagggcactgaagttcaagtgatatcactgctttcttaaaatagttttgtatagtcttgcaagagcacaaaaacttaagtcattaaaaaaaaaacaaaacttcagtttgtctcattttgagatattttctttactccttccatgagctgatcttgatagtgatggctgttccacttgaaagtgaaagtcccttcctcttactcatatgaggaaaactctgttctatcacgactgacaggcattttcttataaatccaaaaaggcagcaccttttaaaaaaaatatatctacctaagctttcccccaactgtacttgcattacatagtaataattaatctaatctacctgtaggcaaacccgcaataaaaaaaaccctcagtgtgttgtgccaaagcaaggacagaaaaacagcaatcttaaccctgaagcctgtgatatttgtgtcaaagaaacagcctgtctgctctgcatggttaaagaagcctggtttatcaggtagcatcccacacgattccacagggcactcagtcacatggttaactgttgagggagggggaaaaaactaatttaagaaatgcactcagtttaaaaatacaagaaacaaacattaggaggaaaggtaaatatacattatctttacataaaataattaacaattacacaaaatttggaaaacaaggaataggaaaaatatacttagtattctctcctctttgtttctacacattttcttactcagctataatctcatttcaaatcattttagatccagtttacaacctatgctcaggagaaggctgacatagcattctacagaattaagttagcagtaaggtgataatacctggcatagtatggtggctgagaaaggaaaggatataagtcatttcaaagaattaggcctggttactgacaatagggcatgaacaaaagggatgaattcaagatggctttaagcctgcttggaagatgtaggtgacattggcagcgaggcaaatcagtgttaggtctcagcttctaattcgagtggccctattaatctagggagtacactctagggaaggtggtatgtggtagaatagaggctttggaattggacaacataggctttagaattggacagaaatggtttccaatccattggctgtgtgattgagcaaactgcttaatttctctgagccttatttactaatgtgtaaaatgagaacttaatgagatgagatttcattatttctctccaagaaagagttaactgcctggtgcggtggctcatgcctgtaatcgcagcactttgggaggcccaggaaggtgcatcacctgaggtcaggagttcaagaccagcctggccaacatgttaaactccatctctactaaaaatacaaaaattagcaggccgtggtggcatgtgcctgtaattccagctactcaggaggctgaggtgggagaatagcttgaacctgggaggcagaggttgcagtgagctgagattgcgccactgcactctggcctgggtgacagagcgagactctgtctcaaaatgaatgaatgaatgaatgaatgaatgaatgaatgaatggttatgccttataattgtttatcatggcataaaacatatttttggaaaaaagtccatcaaaaatagttaaacagccaggcatggtggctcacgcctgtaatcccagcactttgggaggctggggcatgcagatcatttgaggtcaggagtttgagatcagcctggccaacatgatgaaaccctctctctactaaaaatacaaaaattagccaggcgtggcatgcgtctgtaatccccgctacttgggaggctgaggctggagaattgcttgaacttgggaggtggaggttgcagtgagctgagatagcgccaccactgcactccagcctgggtgacagagtgagactctgtctcaaaaaacaaaaaaaaaaagggggtcatgagttcacatcctttgaagggacatggatgaagctggaaaccatcattctcagcaaactaacacaggaatagaaaaccaaacaccacaggttctcactcgtaagtgggagttgaacaatgagaaaacatggacacagggaggggaacgtcacgcaccagggcctgtcgagggatggggggctagggcagggatagcattaggagaaatacctaatgtagatgatgggttgatgggtgcagcaaaccaccatggcacgtgtatacccatgtaacaaacctgcatgttctgcacatatatcccagaacttaaagtataataattaaaaaaacatagtcactgataataccaaataattttgtatgttgggatagtatgggaagttaacaaaaaagggaaaaacaattttggtttttgtagaaaaactatgccaacacagttaaaaaacagaaaagatgatgaaaagttttatatgaatttctgcattaaaaaaattaagttggttaaagcattaagggctaaaactatgccatgtacagcaacttatgacaataaaattagacacagaactaaataaatataatattgcatgtattattattattaaactctaacaagaataagttaaactaatttataaagtcactgcaattcacatacaaatacctaaaaatgatgccctctgtggtgaaaagcacaattagatttctgattttaatagctgttatccaatcattttcacattgttaaaaacgttagcatttcaaatccttacctagtttttccagatgtatttttgaccactttccggaaagactgatttgcagtggatcttgtagaaagcgttcgaggggaagcacgaacaaaaccagatggtggattcttagggattttctttactaaatgagttacccattttttttgttcatcctgagaacatgctaacagcagcatatctcttgctgatgttacatcataacttactatgttaaggaggaaaaaaaaagcataattaaagccatatagttttttaaaatccaacctatcaaatgcatagtttttcaagttcttaaggttttaaaagttttaatatgcttaattaagcatgaacaatatctcattctccttaagttaaataaggctgaaattaaaaaaaaaaattagtcaaactaataaagtaaaatcagaaatataacaaaatgtaaaacaaataaatgtatttaaagaacataagcttcttatctgaaaatagctatggtctgtattctttccctcaagctacctctgtaaaactagaagatattctgtgatacagcatgcatgctgatccaggcagtgaatgccagacaaaaagaagaggaaaaactcaagggaggaatagagtggaactcacctgttgctcttctctccaacttggaataatttcttagcagcatgtttgtttgtttttgtttgtttacaagggggtgattctctttaaaaacactgttggccgggcgtgcaatggctcacacctgtaatcccagcactttgggaggccgaggtgggtggatcacctgatgtcaggagttcgaaaccagcctggacaacatggtgaaactccatctctactaaaaatacaaaattagccgggtgtggtggcacacgcctatagtcccagctactcaggaggctgagataggagaatcacttgaacctgggaggcagaggctgcagtgagctgagatcacgccactgcactccagcctgggcgagacagagtgagaatccatctcaatcaatcagtcaatcaataaaaataaataaaaacatttttaaaagctaaatctgtaaatagctgcatattgccccaccagtgtcaaaataatactttctataatctcttttcaacttggtatagaaatcactacacataagttagttcattgagacttaaaattaaatttgttataagttgtaacaataattaccatgccttacctttacatggacaaattaagtcctctttcttatctaagtgatctctgtggcacttaacatggcatcttcgacactctagggcagggggtggcttaaaaacatgccagagaggtttggcacaggcatcacaattggcaggaaagtggtagagtgtaggaataaactcatggcctttgtgattttggaaattagttttttcagcttgttgtactggttccatctctacatcttttctacattcaccttcatttgcatatagtatctacattcaggaatggtgaaaggaaaagattttaaaaatcttaagcattggtatattttacatttacttcacaaaaacgcttaggacttagattctttaaaattataacttcagatttttacctggaatattttaggaatttcttcagtttcagctctatacacatctccttgggttacaggtctaacgtgaaacagtttactaaaatgaaaataaatacaggccatttacaaaaactcatttattgtaaaagacatttcactaaagaggacatatgggtgataaataagcacacaaaaagatattcaacatcatcagtcattagagaaatgcaaattaaaaccacaataagtgtcactacacatctatcagagttaaaaaaaataaaaacagtagtaacatcaaatgcttgtgagaatgcagagaaagtaaatcactcatatactgctgatggaaacataaaattacacagccactctggaaaaagaatatggcaatttcttagaaaactaaacatatgcttaccatataacccagcaaattgcactgttgggcctttaatttcaagaaacaaaaattcatataacattttatatctatttaaaaaaacctgcacatagatgttcataggagctttattcataataaccaaaacctagaaacaacccaaataaatgggtaagcaaactgtgatacatctatactatggaatactactcaacaagaaaaaaacaaattatacttggattgatcttaagggaattatactgaatgggaaaaaaagctgatcagaaaagattacacattatttgattccattcatataacactcttgaagagacaaaattatggagatggagaacagattaatgttgctatggattagggagaggtggaggaaggaagctgccttttgactacaaaaggagtagcacagggacacttgtgatggaattgttctgtattttgagtgtggtggtggtcatacaaatctatacacgtgagaaaggcatacagattggaaagaaaggagtaaaactctttatttggcgatgacatgattgtatgcagttgtctcgtggtatctgtggcagattggtcccaggacccaggaggattttgaagagagagagtgaaagagaaagagagagaaagagagggaaggagggaagagacaggaaaaaaagaaaagataagaaatggtgtagtatttgtatataacctaagtacaccttcctgtatatttaaaattgtctctagataatatctaatataatgtaaatgctatggaaattgttattatattatattgtttagagaaaaacaaaactgtacatattaagtacagacacaaccacaataggcctaactacattttcaatccatgtttggatgaatatacagatgcagaacccatggatacagagggctgactgtgtgtagaaaagctctgtggaattgatcccaaaaccccacaaccctataaaactgttaagtgcaaagcaagattaaatgattcaaggtcaacatataaaaacaaatactgttggaacaaccagatacctatgtggggggaaaaaagccaacctgacctaaacatccacctcttaccaaacacagaccacaaaaggcagaaaacattttaaaaattggtacactgatcctcattaaaagacaccattaacaaaatcaacaggtaagcaacagattgggaaatatttgcattacatatttctaacataggattcttattcagaatatatctagaactcttaaaaaccaatcttaaaaacataagcaacccaatttaaaaacgggcaaaagacttgaaaaaagaaaagatatacaatggctaataacgacatgaaagattcttggtattattagttatgaggagaatgcaaattaaaataacaatgaaataacatttaacatccactagaaaagctaaaatcaaaggttgatatcaccaaatgttggtgaggatgtggagcaactgaaactcatactgttggtgaatataaaatagtgtgacataataatttttgagaattgtttggtagatttttaaaaagttaaacacagatctactttataacccaggattccaatcctgggtatttacccatgagaaatgaaaacataagttaaaaaaaggaatgctcataagtcttatttacgatagccccaaattggaagcaacccaaatgtcaatcaacacaaaaatggataaacaaattcatgcaatgttatactattcagcaatacaaagaacaatcaatacagacaccaccacaggtgcaggctgagtgaaagatgctaggcacaaaagtgtacattactgtttaattccatttatataaagttctagaacaggcaaaactaatcttggcaatagaaatcagatcatgggaagaggcacaagtgagctttcctttttctttttttttttttgagatggagtctcgctctgtcacccgggctgcagtgcagtggcgcaatcttggctcaccgcaacctcagcctcctgggttcaagcgattctcctgcctcagcctcccgagtagctgggattacaggcacctgccaccacgcccagctaattttttgtatttttagtagagacagggtttcaccatgttggccagactggtctcgaatgaactcctgacctcgtgatcctcccacctcagccttccaaagtgctgggattacaggtgtgagccaccacaactggcccaagtgagctttcttcataaattaaaaaaaaaaaaaaaaattcttttttcagagacagggtctcgctatgttgcccaggctggtctcaaattgaactcaggccaaccgcccaccttggtctcccaaagtgctgggattagaggcataaccactgtgcccagccacaagtgagttttctaaagaaatacgatttttttaaatcttgtattgagtgattatatgaatgtttacaactgtaaaaagttactgaagagaacacttaagatctatgaactttattgtgggaaattataccttaataaagagaggaaagaaatctctcatcaatctaaaaagtatttaacttagttgaaagatagtatctttcatactagtgtttatgtattatttcgcttaagctgataatttaaattttgacaactaaagctgtttattaaaaaaacagaaaataaagaaagagtattctctagaacttgcttaattcttttcacattctaactataaccagctccacaaatacttaattccaaagggatgataatactttattttatatatatatttcttttaaaaagcagttaccagacttgactttgaatatatattttgttgaatatgttttgccttttctcctgctagtcggtaaggtccttaatgatggaatttactcatctttatacatactacataatctatgataatataagcagcaataattaagaaaagattttagaatgaatataagaaaaaatactatattataggcctctttgacctatcattacaaaagaacagatatatttatatttccccttaataatgaccaaagaatcctacacagttgttcttttatatccacagggaactgattccaggaactccaaaaatatcaaagtccaagtatgctcaaggctcttatataaaatggtgtggtatttgcatataacctaggcacatcctcctgtatgctttaaaatcatctctgtattactcataagacataatacagtataaatgcgatgtaaacagttgttatactgtattttttaaagaaatttctattattaatagttataaaatatatatattatatatataaatatatatatttatttatatatatatattttatatattttatatatatattatataaaaaataatatatatattttatataatatatataatatatatattttataaaaaataatatatatattttatataatatatataatatatatattttatataatatataatatatatattatattttatattatataatatatatattttatataatatatatattatatatatattatataatatatatattatatatattatataaaatatatatattatatattatataatatatataatattatatataatatatataatacatataatatatatattttttttttgagacagagtttcgctcttgtggcccaggctggagtgcagtggcgcaatctaggctcactgcaacctctgcctcccaggttcaagtgattctcctgcctcagccttctgagtagctgggactacaggcgcctgccaccacgcccagctaatttttggatttttagtagagatggggtttcaccatgttggtcaggctggtcttgaattcctgacctcaggtgatccacctgcctcgacctcccaaagtgctggggttacaggtgtgagtcaccgcacccggccctctttcaaatattttctatccacagttgtggatatggaacccactgatacacagctgactatactttttgaaatgctctctgaactcaaactactaaacacttgaactaaaaaagttgtcttccaaatacatgaaataagtatatacatttttccttctcacattttgctgaagatttaatataatgtcaacatttatgcttaagaaaaacagaaaagtaggtaacagtgctgaagtaacacaaaatataaaataaattttaagtctaaaaataattatcaaaagttagctctcaacccctttaaaattcaatcaaaggcaacttactctatgtccaataccatagatggattggattgctccttatcttgttcgtcattatagaacaaaatttttttgctgcttaccacaacatactgaaataagaaaaaggggggaagagttacaagagcaacattaacttggtttaaagtgataagcataatatttgccactaatatctagattatactgtattaatgtaaaataaatgctagtaaaaaaaagtagctaatataagttctatgctccaaagtaaaatatagaacaaaataccagttagaaaataattaggtatatggtacctgtttcttccagccatatcgtttgatatttcctctatttggtactgaaagccaaccttcaattcttgactctaggagaaaaagaatatatgtattagtcagtcttaaattgtaacaaaagaaaaactattaaaagttgtctgacagcatgcagcaacaagcaattgaacacaactaaatgaataagtgctataatttgctcttccatgcttcaatcacacaaatcaactttaatggccatacaaatattgcagaaaaaaattccaagccacttttcccatacaatttaacatttagtaatcaattacaaaagtatgaagtaacaatacccttaagagccaggcaagactggaatggattgcagcttaaatgggatatgatgtagaagactttatcatttaacattcatataaaaataatcagcaaaaaaaaagaaagaaaaaaataatgcagcaagtggaacaaatcagagccatgatttacacaagaaagagcaagcaaaagtatagaagtgtcctattactcacagaagacaagaatagaagataaataaataaggaatgcaggcagaatcaactagatataaagaataagagacaagtattttatttgttttctcagtacaatattctgattaagctttttggtaaaacaacttcaatttgaatttgtaactatttcaataaaattgcccaaatttggttgaggggagcacttaactctagtgctaagttcaattgcaattctactcaaactaaagagttttaaagcctcttaagtttctgatatcacaatttgatcaacagtaaaaacaacacagaatccatttggtctactgccattatttcaactagtacgtgcataccaggaattccttgactatttgatcaaggcattttataataattattactattgtttaaatataactaatgtctactagaaatatctgggggataaagacaactccattagaaatagttattttagatcaggttggaaataagaaaatccattcaatttaactattttccgtatctaccttatatttgaaacacaaaagaatagaaaaataaccaatttcaaagtatgacactaaaatatgagattatactatcattcaaatggtaatcctaaggcaatatattgtccgccttcatataatttaaaagctataaactcagtcttacagtaacagttaacaataggtaacatttactgatttatttattcataaatttactatttgccacatgctttataatatctcatatttaacctatgtataagtccatgaatacaggatattatattccgaggaattcggaaaaggttctactgtcatctttcacttacaaaagaagagactaaggcttagcagggtaaacggacttgggcaaggcaactctatcagtatctatcaaagctctatggtttcaaaccccggcagtctaatttctgagcttatgtttctagagcacaacactattctgttcgcaaacaagctctgcagttgactgaattgtgggaaatatttttttcccctactcccaccaggtacgtaatgtctccacacctttgcttgtgttattcctcttcatataaattgttaaaatggaggaaatggtgaggtaactttagttcaaaatgatccctctcttctcccaacatttttctttttcctttttttttttttttttttttgacatgaagtcttgttacgttgtccaggctggcctcaaactcctgagcctcagcttcctaagcagtggcatgtaccacagcacctggctttaattgctgcaatttagttcatgaagtaattattttgttgcttaggtagttccttggtaagttttgtgagagcaaggaccatatcttaacacttgattttatatatcccatggcaaatgacacaacgaggtggtacttgacagatatttgttgattattttgtaattctgcatttttctgaattagccaattaaagtcatcctttgtaaatagtggttccagtttaaaaaccaaacaggcagttttatactaaatagcatgcagaagactgttgatcacatattgatcattcaccaatattttatcttataaaagcaaaaaagttattgccagaaattttcccattagtgtggtagaaattgcagctctggttttaaagtgtagtttggaaaacattaagatgaacattagtgagaatgaaaaggagtcttaatatctgataatacaaagttgtttagtattagtaattcctcaccaaaaacaaagatataaaagcctttgaattcttgacatttacacaaaatttgtatgccaaaataccctatactttcacattatttctttgtgacaatcaatgtcaaaaatatttatgctttctggctctagatgtgggttaacctgccagttttaatatatcttcaataagttgttatatggtatggctttatctgtcatttcagtgttccttagaaattttatatatcaagggaatcttatgagtcaaataagccagaattctacatttgctcatatttaaattaaatgaagagggtcagggagaaaataaattaaatgaagaaatctggaatgcaaataaaggtgtcaagaatatgtgaaggtttttgccaatttacaacaatgtcatgggagaaaattttagtttttccatctggtgaattccctcagagaagcaactgaactaagctcaataataacagataaaaaaatacatactagcttctcctgcgtttcctttccttacgcctaccatagttgcaagataatatacttaccagtttttaaaatatataaagacctcctctaaaatcgggaccacctgtaacttaagtggtgatctggaggtataacgctgtaaattccatcttttatatcacaagcacagaaaacagcttctccagataactaaatgaaactcccactgagagaacctctaagtctggattatccttaataatattctacatatgtacaaaaacaacttggctctaaattttatacaatatatttgtagaacaattttaacttataagaagttagatgtatattactgcaatatcagcgatttctttacccaaataagagacaatctaactacatgtacatcaatactcgatatagccaattcaaacatcagagctaacctctgaagactacctaatttatttagctataccacaaacatactgcttaagaaacagggctaaagaaccatttcaaaacactttaattaaattcaaaagtgatataaaaaagaaaattaattaatactcaacaagtcagatacaccaacttcaaatcactagatttgggcaaggtcagaaacattcatatattcaaatattgggaaacacaccaagagatccaccattttcaggtttaagttacataacctaaggtcaagctggatggaaaagggtatgatacaaataatccataagagataatgaatattactggagtatcaataccaagttttcctaatccatcatctatttctacattctcttcagatgtctaggttaacagttccaaaagaaggaaagagaaagaatgaggaaaagaaacagttatcacattaaagttttttgtcatctaggcaacaggcacccataaccgtaagggtaatctttatgtttgtattgtgtgctaggtcacaacctgctacagaaccaaagagaagataaagacataaaagaattaagagaatgaaggtgacttcaagaacttcaaagagttataagtcagagaaggagtaacattttttaaataaagtttttagaattgggaattttagaagggagatttaatatttaagctagttaataacaaaatggccactaaggattcatagaggctgcgttctagatgtgcaagataattaaattataatctttatactgaatgatgaaatataagagaaataataaaagttgcagtgtcagtttatccatccaactacttaaaaaaaaactgaaaaatgtgacccatatttcaaaaagccatcattttaacttggagtaaacttaatctattcaaagccctctcctttttagtacgtatattcatttacttattttctaaactgaagtaaaaattaatcattagccattaccttcaagaaattttttagacacttgaatgatatgtaactatctaatattaagaatgaatatcaacattctttaacaattcttcctagatatgaatgcaaaaccttaactttatttgccagggaccatttttgagcatctagtaaatggtggatttaatacagattttcaatttactagcaaaatatctgacccacagagaggtaaataatattgacaaagactatccattaatttctacttccaatatgaaagtcaaggttcagcactgttgagattttataaagtctcaaaattaagaacacagtaataggaaaagaggtattaactggcctcttctagcaagggagaatggctaccagtactccccgccccacttggtttggactttgataaccttaaaaacaaaattcctgaaagtacactaatattctaagaaatatactgaaaatggagctagtagaaacatttaaaaatctctttgctcaataagtcaatttattaggtcaggattctgaaacctaaatggattcccagcctaagtctgccaatgaagccagctgatggcactatgagcttagcctttctgaatcagccacgatggtgggtaaaattaatcactttcctcattagcagtcccaccagctcacctttcaactcaaatcttctaactagcattcaccaataatgtgtccatttctgacatatttaacccaatactaagaacactaaggtgcatataaggcattataaatagttaaagggaaatgggtggaataaaaataaaattggtcaggatttcgaactgacactaaatagagcaaggtcggccaggcgggtggctcatgcctgtaatctcagcactttggaaggccaaggcaggcagatagcttgagctcaggagttcaaaaccagcctgggcaatatggtgaaatcccgtctctacaaaaaattaaaaaaattagccgggtgtggtgatgtgcacctgtagtcccagctactcaggaggttggggcaggaggatcgcttgagcccaggaggcaggatcatgaaccaagatcacgccactgcactctagcctgggcaacagagtgagactgtttcatacatacatacatacatatatacatacatacatacatacatacatacatacatacatatatacatagagtaagaatgtatacatacatacatacatagagtaagaatccctatactaaataactccagaagtatctcagggttaatgaagtgggaatctaacctaccaattcagttcaacaattgaaagaatgtagccaaacacttctaaaagtcatattcttagtgatgattaagtctaactttagaaagatgttcaaacaataactaaagctacaggttcttattaaattcaaagtgatcctacaataatgaatcgtgtgtacctgcaagtttctcaagaggtaggcagtttcagagagccaaaaataggtaaacagaggagttccttgaccactaaaataagaaatatttcttcgctgcctttccattcccagatacctgattttgacctagcaaagccacacaagaatgaggccagggatcacatagcatacagagaggagctgaattcatttcccactttgagtcccactttcttgaccaagaaagatactataaaattttctgagtgactcctctagttccttatatcaaattcacaataacaagtaatatctgttaaaacagaatcccaatatcaaacatgctgcttcataaatatcttcctatttatgtattattcagaaaatacactaattaaaatctattttcaagtgtattatcatgtatacaaaacttccaagactctgaactaagactctgtgtatatgtaaatgcatgttttaataatgataacctactcattttatttctaaattgaacttatagtatgtgtatttctcatctctgtaaagtacataaaggtattatagtttacatgacgattaaaccaagaatgaggttgtgtttatttttaaattgattctccactgggaaaaagaagacacagaaaaaagtctcaaatcttagccactcattcctgcctttatttgacacccccggcctcttactgcactgcccaacccattttatctatttccccaaacttaaaacttagcaaagtctgactgaagttgatcactactccactagatagggttctatatgtagctgctgtggttctgatgataaagtacagttcttagttttagcacaagaatacataaaatgttaaagagctattactcacaaaaatgtacaacttttaaaaaatagtgagatgtgtagtagcagctttgactctcactgtggacttaggctgctcaaaataggttcataaacctcttatggtttttattcaggtaaagcttcttaggtctatttaaatagcctaagattgcttacaactgctctactccacaaaatacaccaagtgtataatcatcatcaggccttggctatcagaaataagaattccttcttaggaatccatggacaaaatgacaaggaggtagaaaaccaaatgaaagaaatatacactaatttccatgacatttatacatgtttgaatgatacagaattattcttacctgggaggttaccatcagtttcatcagcactaggaaaactagcaacacttgtagaatccgagaggtccaaaagtttagcacgcaattgctcaatatcactctctttgctggccaactgcatctgaagctcattcctatgtgcacattcttctaccaattgctaattttgaaaagtatcaagataatataatcaagctaaaacaatttccaacattactaattgaaatatgataatttaaattgctaatactaaaaatgtacagtaaacttcatgaatgtttgctaccacagattttgatacactacagaaatgtcaagttctttctcagtaatacaatgctcggacaaattccttttctccttgccttaaaaagagtttttgtttttgttttcaaacataagccatcaaaacaaaaaagttacaacaaaagaaaatgcttttctggctccaaatgaagtagctttaaaggtatagaaaacttcagaaaaccataactgatggagctaaaaagcttagatctaagtgcccgagaccaggttctcaattttgttctattaacaagccaaggggtatcaaaaaattaagcttgttattttgatttcaaaaaagtgagtcttgactagagaaaataaataagctacaatacttcaaaacctctaccccaattatagttaatattataacagccatatcccaatttcagtctgaaaccaaacaggcagaacccttgattgttcccaatctaaacaagataaatagataacaagtatatacagaaataatttaagaaaataatccttcacactcatatccatacacacacagaaaccttaccgcttgcatgtcattcagttccttctgatgtttcactaccatctggttgaatttctctctttcttggttgagttccagttgcagctttcgattttccttttctttctttctcaaatcttgtgtattagctttctttctatcaattttaaaatcttttcgattcattatttctgccaatttgttaacagcctattaaaatattattaataaagatcaatagtgtagtcatccaatttaatactaaaatgtatttttttcttcaaaatcaggaagcaggactttctgtgtgtatgaaaattaggacaacttcatgatggttgagacatgataactggtagcacaagtaactaacactgacttatcacactacttaaatgtaagaaccaggagcctttctttggttaactttacaacccagtactgaatcaagagtatgctaatcctactctgatgttgggtactagcaaataaagcttctatgccttggccacatactcttatcttctacaactatacaatattactaggcaagttagctttcttaactgaaatcctatttctttttttttttttgagactgggtcttgctctgtcgcccaggctggcatgcagtggcatgatctttgctcactgcaacctctgcctcctgggttcaagcaattctcgtgcctcagccacctgactagctggtattactggagcgcaccaccacgcccggctaatttttgtatttttagtagagactggggtttcgatgtcagccaggctgctctcgaactcctggccttaagtgttctgctggcctcagcctcctaaagtgttgggattacaggcatgagccaccgcgcctggccttgaaattctatttcacaaataagttttttatagttagcggggagagaatttatttgttctgatgaaaagcttgaaccttataagccttggttttaggaaaaagtgcataaagagcaatgattaactcaaaaatgaacatgtggaaaagatcgaaagcatgtatacctgtgttttaagggttcgttcagtgttgatattcttttcaaaggcagccttaagattactgatctcctcctccttctccagtttatattctgtcaacaaattatattaaatgttattgtatggtattaatttaatttctgcatttcaaactaacaatgtctttaattattcaaataagtatacattacatagtaactttcagtaacttcattaagataattcttaaggctacagaagttacttaatatatgaaaacaggtatcttagaaacctaacacaacataggtaaagataaatcactgaatttgatttaacatgatgattttttaaaaattctacataccttcctctgccttcttcattttctctgttagctcttcattctctcttcttaatatttcaatatctttggttagcatgctgtttgcttcttcaagctaaacaaagcacacaaaagtttaagctccagcctctttgctattctcgtatttcaggcagtaacctttaaatatactgctagataaagacaggtcagacactgctgaactacagcaaatgtctggtttccagcttaaaatatgtaattacatcaaaaatatttaaaagtagttaacagcatccaaaaattatttcattgtatgcatatagatatatgtatgaacaaaaggggggcatatgtaatggcaagataactagattgcaaactaagaaatttgtatttagttctagctctgcgattaacctagtatgtgaccccgagcaagtcatactttttctggacttcaatatctttatctgaatattgatgatgaaaacgataataaaaacatttatttatagattacttttagtaatatataatcattacttgttatatgttatattaatcattctatgtctactgtcttatttaatcctcataacaatcatgtggaagagatattactatttctattttatagatgagaaatctgaggcttagagaagttaaagccaactttgccaagaccatataacttcttaggggcaaaactggaacccagagtgactgatagtggctttacaagaaaaatctaactcctctttttagtcgcatgattctatatagattacagtataaacctcaggaataggtaattgtttggagtattggttttcttataatggatttatatattatcccaagaattcctcattcccaaatggtttctctatatttcacagaattctggcccataaaatcagttgcaatgtattaagagaacaacaaatgaatttaagctaagccattacttcatatgaaatataactaataagatctacagccagaaaaacagcccaatattgcattggttctgtgcctatacaaacaaaagcccaatatcttgaacaagaatttcaataattaacaaatgtttggtattatacaaactattttatacatgagtacagaatgaccactatgtattaacatagaagtaaatacacttgcacacacacttaccctaatattttaagatgtgacctattgtgatttaaataaattttatataacttacctgactatcacacttacccgactaacagtgtgatctttatctgtaatctcttgtctatttcttgaagcagctttcttgctttcttgcgtcaattcaaaatactgttcttccagaaggcctcgcgccaactgctcagactcagcttttgtttctgctagatccaactgagtagcaagagtttctctgcaacaattttttaagagaaactgatgtaaacaaattcagttcatccttccaacttaatcatattcttaaaaacacaattaactttaaatgataaaaagaattattttattgcttaaaataaatttaaatccattgcaaactttctataaaagtaatgaatttaacctctcacatgttgaaaaattataaaagaactatttagttttctatcccatattgtgcttaactaaaaaaggtcataaagcaatagcaaatagtctgcttttgaaaagaaatttcttgcagatttggaatggaaggcagcgtggcatagtggaaaagtcattgacttgttaatcagcaggctagacccagaactttatctctgttttatcattaactaattgagtagagacactgggcaagtcccttacacttcctgcagttcagtttcatcaaatctgtaaaatgagatggttaaactagtcccttccagctctgaaattaaatgagattatgaaaacttataagagatttgcaaatcactacaaactaatctgagaatgctccctggaaatgatactaaaacatttcagaactgacattcagaccaagacaactccagtttgcctactcttctcaaagagcctctcttggataagctctcttagtcactactgtattccctgaacagagtaggtgctcaataaatatgttctgaatgagtaacttccacctcctattttctagtgagtattacaattcaaattttctgcctgaagcctcaagagggagacatatagtaaacatacacacacacacacacacacacacacacacacacacacatacacacagaaaattcattaattcacccaacagctatttacttgaaggtttactaagtactacactatgtttactatgcatcacgctgttctaggaattaagagatacagcaggccggaagcagtggctcacccccataatcccagccctttgggaggctgaggcgggcagatcatgaggtcaggagttggagaccagtctgccaacgtagtggaaccccatctctactaaaaatacaaaaaattagccaggtgtggtggtgtgtgcctgtaatcccggctacttgggaggctgaggtgacagtgcaagactccgtctcaaaaataaataaataaataaataaataaataaataaataaataaataaataaataaagagacacagcagtaacaaagttcctgccctcagggagcatgcattagtggggccgtacaggcaatttaaaaaatgaacaagtgctatatagtatgccacagagaataatacaagataaaatatggaaagttatgaatatgatcacttttattacaggttgatcaaggaggcctctctgctaagacaacagtagaagaaaagtagggggaagagaacaacagatactgtaaggctttccaaggcaatacaaggactttgacttttattctggtactctggtgttttagaaagatcattctggctgctgtattaagatcagacagtagggggacaatggcagaagctgggataccagttaggagactactgaaataatcaagattggagatgatggcagtttggaccaggtcagtaaatggtacaagtggtgagaagtgattagagtctatacataatttttagttaacactgggaaaatttgttggtggactgcatttagagtgtaagaaaaaaagaagagtctaggatgactctaaatttttcacttaaacaactaggaataacagaattgttcaggactgaaatgaggaagacaggaaggagcagttcgcaaggtcagggaatcaggaagtttttctggacacgttaaatgtggggtgcttaacactcaagcagagatgtcaattagacagctggatacgtaagtctggaattcaagggaggatgtacttggactctgacaccatttaaagccacaaggctggatgagaacaagtagggagtaatcccttgagcactccaaacttttaacggtctcagcaattagaatggaaaaaggaacaaaggaggctgagaaagagtagccagttcaataaggaaaatacagcatgtggtgtcacagaagccaaatgaagacattttctcaagagagtaatcaactaagtcaaatcctgctatgaaataaggtgagaactgagaagtcactattaggaagaccccactgaccttgagaagagttgttctgttagcatgatgaatgcaaaagtatgactggagtgagctcaagagagaatgaaagaagacggtggaagatacctggtatgtcacttttcaagtaagttggctataaaaaaaagaaaagtgggatggtggctaccatgtagataatgtagttaaaagacgcagtttcgctcttgttgcccaggctggagcgcaatggtgtgatcttggctcactgcaaactccgcctcctgggttgaagcaattcccctgcctcagcctcccgagtagttgggattacaggcatgtgccaccacgcccagctaattttgtatttttagtacagatggggtttctccatgttggtcaggctggtcttgaactcccgacctcagggaatccacccgccttggcctcccaaagtgctgggattacaggcgtgagccaccacgcccggtgtaagagggttgtttttagaggagatatctaaatatgtttacataacaatgataatgactacaaaaaggtaaaaattgatgtagaaaagataagagaattgttggaatcataattttttttggagactcagtctctgtcgcccaggctggagtgcaatggcgcaatctcggcacactgcaatcttcgcctcccaggttcaagcgattctcctgcctcagccttccaagcagctgggactacaggcatgtgccaccatgcccggctaatttttgcatttttagtagagacggggtttcaccgtgttagccaggctggtagcgaactcttgacccaagtgatccacccacctgggcctcccaaattgctgggattacgggcatgagtcaccacacccgaccaagtcatattcttaagtaggcaggaagagataggatcgagggactagcattagataagagcgttagctcatgatgtccatttacatcatcagaaggaaggcagggtttataggtactattctctacttagaagctattctcaccaagataatgagtagccttcaaaataaatacaatggacaatttatgacttttttgtgacctttctcaatatttggcactttttttttttttttgagatggagtcttgctctgtcacccaggctggagtgcagtggtgtgatctcggctcctcccgggttcacgccattctcctgcctcagcctcccgagtagctgggactacaggcgcccgcccgtaattttttgtatttttagtagagacggggtttctccatgttagccagaatggtctcgatctcctgacctcgtgatccccccgcctcagcctcccaaagtgctgggattacaggcgtgagccaccgtgcccagcaatatttggcacttttaatcactttctctttcttgaaatatcctcctcccccagtttttgtgatactctactctgatgcagacaagttagtagctatggtggtgaaagagaatagatgttctcttctgatttttaggaagcaaggccattagctaagtacaagaataaggaaaagctggagatctgagtagagacgagatgtgaaataattttcttaggagagtagtagagttagtactttaggaaaagaaaggatatgctgccaatgccaaatctaagaatattgggagtggttctgctagctactataatacagggcttcaggttcacgacatgttcttatctggagtttctgctttgtgttaagataaaagtatctgggttatactttaagacaccagaaaacctatttaatccagaatatatttctatccctggttatgctactgtgcaagagaaaaagcaagaaagaattagatggttcagggtaaaattacctgcatctatacattcatccagacttcctttacaactctccataatgaaagactgtctttactaatatttaaggtcaatctctcacccttattctcctacctcttaaaagaattcaataatcaataattccatattcttctggattataagattataaagaatggctttgttcttgtttacaggtatatttcaaatgcctagaaaattctctggcccatagaatgcgctcagaaattttatttatttgaatgaatagatgtggggctgttcctactctgatctccttcccatgctccatttaaatatgctcaagtttacactactgttaaaaagaaagtgctctccttcacactctcctctagctactgctacatccccttgccataacagccaagtctcctgaattgtttaatttaacaaacacttgctgagcatcacaatgctgcagttacaattgtaggtgctagacatacagcaatgaattgaacctaagaatgaaatatctgaaaattcctcctaccatagagctttgtttctagcggaaaaacaaaaacaataaatacaacaggtaagaaaattatatattaggagggaataagtgctgcagagaaaaataaaatagggaaggatgaactgggcaccacggtagtggggtggggatgtttgcaatttaaaaagcatattcagggaaggccttgtcaaatgatgtggacctggagaagggccaaggagcaagccatgtagatacttggaggaaactgttccaggcagagagaagagcaatgtacatacctggaagtaggagagtgactaattggtttgttgaatagaaataaggctaatcaggctgttagatatactctgtctcttgttttaccctttccattcagtctcaatctactttaatacctattctcatctctatttagaagctgttctcaccaagataatgaataaccttcaatataaataaatggacaatttatgactgtttttcttgacctttgtgggtatgtggcactttttaaaatttaatttaatttttatttatttattctttttttgagacagtctcactctgttgcccaggatggagtgccgtggcaccatctaggctcactgcaagctccgcctcccaggttcacgccattctcctgcctcagcctcccgagtagctgggactacaggcacctgccaccacgcccggctaatttttttgtattttcagtagagacggggtttcaccctgttagccaggatggtctcaatctcctgatattgtgatccgcctgcctcggcctcccaaagtgctgggattacaggcgtgagccaccatgcccggccaatatgtggcacttttaatcactttctctttctggaaatattctcttaccccagcttttgtgatatcctgctctgatcttctcttacactgttggtagcttattggtttcccttcctctgcccattccttaaaagtctaggagctagtagtctttcctcagcctttgtgtcttctgatcctacactatggattacaatttgctacctgagaggaccaaatgagcctacaacagtgccccctgcatctatatattcatccagacttcctttacaactctccataatgaaagactgtctttaataatatttaaggtcaatctctcacccttattctcctacctcttaaaagaattcaataatcaataattccatattcttctggattataagattataaagagtggctttgttcttgttcacacaggtatatttcaaatgcctagaaaattgtctggagggatccagacacacatacacaaacatacacctaaaagagttttgggtcaaccttttacataaaaattcagattcttggtttctcttgaaaaatcagaagatcctgacatactgggccagtgttatcatgtggtaacaaatggctggaactgagaaggcgagatcttcagtttgttacaatccttacaacttacattaacgaatatatctgcacttagaccccactaattacagcctagttacacctatggcatcataggctcatgagtttataaactctgagatacacaatcaccttaacagatctctatattagtggtttctgtatgcaaagactatcaaatcagcttcaagttcttatcttttatctgcattctaaagcaataagcccaaatacagtggtatccatttctgtttggacatcccataggcacctcaaactcaataggcctgaaattaaaataatcttctctcctctcatctcacaattttggcattccttagctcagggaccagcactaccatcaactcaacagctctggtcagaaacttgggagtcagcctgaaaattatcctaacctttacccctatgcctccaaatctacaaatcctacttcttttacttcctacttcgttttatgcacttgcctcctactgccaacttccactataattttacatctaagttttgccagcggttatataattgggctccctgcatccacccagctttcccttacttcaattcattctccactccttagagtgagttttctaaaatacttatcagtcactagcttaggattttcatttattcattcaatatttattgaatacttattctctgaaagtccctgattggagtgctgggaatagacaatagacaacaatagaagaaacaaaagtccccacttttcaatattttaaactcttcagcatgatacacaaggtcctttgtaatctgactcagttttctctctccagccttatctgtcacgaactaaccatttgctgttcctcagatcacagattggcttctgcctatattgtcccttgttccccacatcccattccctggctaattctactttccatcggttgtgatctctgttaggaaatgttctctgaatcccacatggtaagatgaggtatcctttggcatagccactataccttgattatatctctcctaacttgattctgaagcacctgaagaatcataacttactaataattggatagctgcacaaagcacagtacttatagcacaatactggtgatccatatatttgtcttgaatagatgaaaaagggaaaatatatcaactctgaaacaatatagtatggattgaatatttggcacttttaatcactttctctttctgttcctcagatcactgattggcttctgcctaaactgtccccttcacagtgaatgcatacacctgggattgcatattgcactgtgaataccacacaaatggtaggtaacagactagattctacaatatgactatatcagagaataaccaggaaatgcagctttgtgtctaccttagcttccagttaattaggttatctaactatgatacttggccaccgaattagtatgtttatacccgctgtgatgctaaaatttaagataatatacagctctgcaacaaactattgtcaattttggaccttaaatattttaatcaatataatcaactcgattaaggcaacttaattgcaaaaagatgcaattatacttaattgtaatcaagtcaacaaagttaaacaacaaaaagtctaagtttatttataaaactagtgaaaataaaagttatgtattccaacaaaaaaaaaaaaaaatgaagaatgataaaagtgagtatctccagtttgcaacacctaatgtattaaggatctaacattgaatgccatagtggttaacaacagaaataggcaaccagaaagtacaaggctatatatgaattagtcttcttcctcctaaaaatcagatttgaatctgattaagcttctaaatcagaaatgtccaataaaactttccaggatgtcagaaatgttctatatctgtaccatctattataatatggtagacactaactgcatgtgactactgagcacctgaaatacgactagtacatctgaggaactaagttttaattttacgtaattgaatttaaatttaagtaactacatgtggctactggccaccatattgggcagaggagctctagatacaactactgacttccaggaaacataagggaaatggggaatgttcaaccaactacagaaatgcaatcaataaaatcgcaactgagggaacatctacaggacaaaaaaatccagtttcttcaacaaattagttttaggatggtgattactcttgaggtggggaggaaagaaggcataattaggaggtgggatatagtgggcttctgaagtggatagcaaggttctctttcatggatgatgatggttataatgacatttgtcatagttcataagaactgtattagttttgctgttttctgtaattgtttgtttcaacaacagtctttcaaaggtgattaaatgtaaagagaatataacaatgttggaaaactagttctagtgtctgttctgacattacctagctatgagatactccgcaggagttactatcttgttgcgcctgtcagctgaattctaaaatgaagctgttacacttgaaatagctttataaggttttctccttggagatggggtctcattatgttgcccaggctggtcttgaactcttgggctcaagtgatcctctcaccttagcctcccaaaatgctggtattacaggcatgagccaccatgcccggccataacctgcatagtaatcctaagaagaccttaaatacctttatctaacttaaaataatgatttgcaaagacagcatgatttatatataaatagatcttttaaaattgatactagcccaggcgtggtggctaatgcctataatcccagcactttgggaggccaaggtggacggaatatgaggtcaggagtttgagaccaacctgaccaacatggtgaaaccctgtctctactaaaaatacaaaaattagcggagcgtggtggcgcacgcctgtaatcccagctactcaggaggctgaggcaggagaatcgcttgaacccgggaggtggaagttgcagtgagccgagatcatgccactgcactccagcctgagtgacagagcaagactccatctcaaaaaaaaaaaattaaaaaaataaaaattgcaatacccctgaaaacaattgtcaaaccaactttttgtcagtttaatgaatctctgcaattggtacagtgttgatttatagcactgtttttttcaccataaaggcaaatttcagcctaatctgatttgttctgaattagcccaataaactgtgttctataccattcccaccagaataatggcacatctattcactaacttaaaacttaagaatgcctgttgcagtactgattcttgttctaaagtaaaatggacatacttttcattttgtagttcctgtattttctttaaattttctctgtttttttcttcaatttcttctttaagttcctttacctgggttttataaagtgtctgcaaaacaagtgacaaggagaaataagtgtttatggtgggttaaaaacaatttggcagtttcttataaatttaaaaaattaacatatgatccaacaattccactctcaagtatttacccatgacaaatgcaaatatatgtcaacacctagtcttacacatgaatttcccttatggttttatttataacagctccaaactggaaatgacccagacatccatcaatacatgggttaaaaaaaaaacaaaaaacaaaactgtggttaattcatattactcagcaataaaaaggaatgaactactgatacatacaacatgtaaatctaagaaatctaaaaaatatgctgagtgaaagaaaccacgtgttaaagagtgtatactgtgactccatgtagatgaaattctaggacaggtgaaaataatcaataatcatggaaaaacagtcattgtctgtgtatagaggtgggtggggaaaatgtagagtgaagggccataagggaactttttgcagtgaaaaaaaaatgttccacatgttgactgtggtggtggtcacacagatgtacatatttgtcaaaatttactaaccagtacacttaaaatgggtatattatatagaaattatagcttaatggccaggtgcggtggctcacgcctgtaatcccagcactttgggaggccaaggcgggcagatcacaaggtcaggagattgagagcatcctggctaacacagtgaaacctcgtttctactaaaaatacaaaaaattagctgggcgtggtggcatgctactgtaatcccagctactcaggaggctgaggcaggagaatcgcttgaacccaggagtgggaggttgcagtgagccaagatcatgccactactctccagcctgggcgacagagtgagattccatctcaaaaaaaaaaaaaaaaaagacattatagcttaataaagtgtattatagatttgggaagacgttataaagaaatttaacacatattactaatttaaaggttagatcaattcttgactaatgttagaaaaatcacttctgttttgaggggtgggatgtactgggtagttgagagacaggtaaagaaatatccacaaaagggccgggcgcagtggctcacgcctgtaattccagcactttgggaggccgaggcgggcagatcatggggtcaggagatcgaaaccatcctggttaacatggtgaaaccccgtctctactaaaagtacaaaaaattagctaggcatggtggcgggcgcctgtagttccagctactcgggatgctgaggcaggagaatggcgtgaacccgggaggcagagcttgcagtgagccaagatcgtgccacttgctctccagcctgggcaagagggtgaaactccgtctcaaaaaaaaaagaaatatccacaaataagatttatcaagtattctgctaacatatctataatatatgcttatttcagaacaatggctcttacaaaattcactaagcttttgccaacgccagtgaaaaatatttaacacatcagactcatattgtgttagttgctgaagttacagagtgaacttccagttctgatgtctatttctttttaactaccctcttcattttaaaagaaaaagagaagggaaagaaatagcaagggccaggaaacagctgtggagaactacttttaacacttatttattacactaagaaacagcactttcctaggcaaaaaaatacataaatgtccatgggaatgcaaatgaaaaaagaataagggcttactctaggttaagtatttataatttctaaaattaatctatttggcctttaggactcagattcttatctctctgacttcaaatactgaaattcaaataagtaaatcaatgaagggataaaaagaaaaataatctgatttgaaaacccagaaaaaagacaaatcttaaaatttggttcataacagcttattgaattgaatgctatttaatccaatgcccacaagcaatggaataaatcagaactgagatagggtcaggttttgtactattttctagaagcaaaatcaaaaatccacaagaatcaccacaagtcatttgacacccatccaaacatttggaggcactggatgactgctctgtggaagcatatggcaagaaagcatatgggatgctaccgatcactttgcagaagttagcagtagatactttgaataattacgtttagcaaacactcagggaaagagttttcaacaatatttaaaagtctttcattttgtttatgagacagagtcttgctgtcacccaggctgcagcacagatgaccttggcttattataatgtccaactactggactcaagcaattctcctgcctcagcctcctgagtagctgcgactacaggtgcctgccaccacaatcggctaatttttgtatttgtagtagagacggggtttcaccatgttggccaggctggtcttgaactcctgacctcaagtgatccactcgcctcggcctcccaaagtgctgggatgacaggtgtgagccaccgcacctggcctgaaaagtttttacaatttaaaaacatataccaatgatagcctaatatgccaagaaacaaatggacaaacaaaaagcagaaaagtcacaatgtttattagaagatgaagagtcatttgaaaaagaattacagttcacataaaagaatctaaataccttgttttaagtcaggttttgaaacagtgtgtatgttaaaaatgattctcacttaccgagaaatattgctcagcttcaagctgatcttgtagctcccgcatctgtccttcatttcctctatactgtcttcagatgaaaagaaaaacaagtgaacaaacgctcctacttatactagacttcattttttcttagtttgttaaagttgctaatataaaaaagtttactaaaacaatctttattttttaaaaacatacttcattattcattattttactaattaacttggtcaggccacaccggttctatcttgctccttataaaatgacgctatgcaaaagtagtgagaacccttttctactgatgatcactttttggagaatattaattgtggatctatccaaaatgaaaaaataaaattgataccatatttttggtaaatttttacagagaaaagcagtcatagggaagaaaatgtcttgtacagtaaataaaaaaagaggggggcatgaaaaatttaataataattcagtgctacatatcatagtactatatttaataagtaataattcagtactgcatactagatattatggccaattaagcacaagaaaggggctggtggaaatgaaccatcaggtaagaagggaaagcaagaacaacaaactgacaaacaaggaggaacgcagatagacaactgcatgtatataatacatacataaacacaactcacataggagcagagtccaaaagatggaaacccaatgtaacccaaagacacagattttcaataattatttactgtataatatgaaagcctagcagctaggcttgaaaatctagcggctagactttcatattagacagtaatagctttgtattctcagtatctcaaaaggcatgtggctgacagaaagtctacaccaatctccactgaatgctgagcgagagtatttttggagaaaaaaaatataaaacacacttttgcgaaaacggtggccctaaaagaggaaaagaatttcaccaatataaatccaattttatgaaaactgacaatttaatccaagaatcacttttgtaaatgaagctagcaagtgatgatatgataaaataaacgtggaggaaataaaaacacaagacttggcataagatatatccacttttgatattaaacttgtgaagcatattcttcgacaaattgtgaaagcgttcctgatcttgcttgttctccatttcaaataaggaggcatatcacatcccaagagtaacagaaaaagaaaaaagacatttttgcattttgagatgaaccaaagacacaaaacaaaacgaacaaagtgtcatgtctaattctagcctctgaaataaaccttgaacatctcctacaaggcaccgtgatttttgtaattctaacctgaagaaatgtgatgacttttgtggacatgaaaatcagatgagaaaactgtggtctttccaaagcctgaactcccctgaaaacctttgcaagtaaattcttttacttctaaatactttttttctgtctttcacaaactctaagtacataatctgtacatatgtaaaatgtcaaacacacaagtcaatgatgaacacaaaaaagaaagaaatcacaatgttattttaaagacttacttcgtaagctgagctaactcaaattctaataatctctttgcttccaataaagtatttatttcctgtttcatctgcttttctaaaccttttaaattgtctgcctcaaatgcttgagtcttcaattcattttgtaacaacagccgcttatttgattcctgctccagttgcagggttagattcttaacctatgaatgagaaaaataattgggatcttaaatctcttaaataatttattagacattatttgaaagactactaaccaaatcaagtacattataattcatggtactagtagaaaatattagtattttaaagagtcttcattgttccacgtgtttattacagtagatttactattaagtcaaattaattcccaaatttcagacatgagatcttgtggagggaaaaaaattctggttcctttctaccccaatcagcatgaaaattctgtagtacaaggtgattataaaactcacttctgggccaggcacagtggtttatgtctgtaatcccagcactttgggaggctgaggcaggtggattgcttgaacccagagtttgagaccagcctggtcaacatggtgaaaccctgtctctacaaaaaaatacaaaaattggccaggcatggtggtacactcctgtagtcccagctacatgggaggatcacttgagcctacgagtcagaggttgcagtgagccgagatcacgccactgcactccagcctgagtgacagtgagactctgtctccaaaaaaaaaaaagccattcctgggggaacatttgaatggagtacttaaatttacctgtctacgtgctctactctacaacccttcaaagcttaaccaaacaaactgaacgtatgttttattcaactcaacaaatatttctgaagtgtttattaggtgttgggaccaatgaactcaaaattcatacagtggtttacaatggccttcatgatctgttctaattctattcctatcattggccattctctacaatccaatcatattcttcagatcctcaaatgcaacaaattctccctcacctcacatttcttgtacgcactactcctgttttatcctccttcatttattcattcttcagctctcaaatgtcatactcttagcaaggccttctgtaactcccaaatgtgattagtaatacacccctatagcattccgtactttctttctaattatttgcaatgcttgtagttactattttaatatctgtttttccctcctggctgtaagttccaacacagtcaggaccatacctatatcttattcacttcggtaacccccaattcctagcacagagccaaataggtagtcaaaaattatgttttttaaatgactgaatattatctttcaaattttgaacatacattcctcctgcatgctagctttaataggtatctctaatttctcttctttctagtccattctatataccactaccagattgatttttctaaaagtgctttcacctatagctcccatgcaagttttattttttattttttagagatagggtctcactctgatgtccaggctgagtgccatggagcaatcttggctcactgcagcctcgacctcctgaggtgcaaggaatcctcccacctcagcctcctgagtagctggaactataggcatgcgacaccacacctagctgatttttgtatttgagatggggtttcaccatgttgcctaggctggtttcaaactcctgagcttaagcaatgtgcccatctgcccacctcagcctcccgaagtgctgggattacaggtgtcagccaacgtgcctggccacccatggaagttttaaagagtatcgatactttggcctacaaatttctcccatgactactcaacatgtcttcgtttttccttcaaaaagttaaagttctatcaagttcctttttatgccttccttatgcatcttcttatccagccggtactcactttattatccatctctttactgataatattccctctagcaagtaaagccctgactccaaaactattaccttttgaagtcttactcaacctttaaaatctaggtaacatgttacatcttcttgaaaaggctttcctactttcagtcttagaaataatttctaaagtacatatagtaaccaccaggacatactgtcattttatctgtttattaactgctttataaaatgtataccctgtgctatcaatctaagccaggaaagactgcagttaaacacttttattgaaatctaagagcaatgctcttttctttggggatataagatgcattataataaagactttttttttctttaaagcagatggtcagttttttcagggaaggaactatgacatttcaatatagttgtactgtcatagtgaaaaatggcatagatcacacagagtgaatgttcaataactatttgaagaggaaaattctaggtgctggggtgaccatacagcagtgaacacagacccatgtcaattatttcattcaaatctccttcatggtgtttaaattatagataactccagtcataacttatataaccgtttctcttttaatagatgaacaaagtcagtactatttttcttacttcatcctccatcctttctttatttccagtcaaatgttctagtttctgctgagattgcttcagatcaacgtctagcatggaacactgtttctcaatctgaacaacccgattttcagccttctctcgagcttctctttcttctttcagctttttttccatctctgggaaagcaaaaagttacaaacatacatttaaagaaagagtactttaacacatttcactttatatgggctgtaaactggtttcaaatgtctctattgtttttattctgggacttgaatagagctagtaattatagaaattctcacattatgtaaactatttatatagcagaaatctctaaagaaaaggagttataaaatataatacagtaataaaatcttctaaacccagctcttgcccagtgatgagagattaatcggtaccactttcagacaagaaggtgaagagtatagctagaaaggaagtgaattaacaaagaacaatgaacatacatcaagcaaaagcagaaaaataaggctgtggttattaatttataccctgcattgttccagaaaaggttgaagaggcttaaggctatggtaggaactccaatttatacaattcagatgaataagattccacagtagtatacctcttttaattattactggaatatattagtctacactgaggctccttttttgaaatataactaagcttctgagaggttaacttttccatgttcatgtaactagtaagttgccccataaggattcaagtttatttaaagtgtgctttcccactcttggagaccaccctctaggtgacaaaatataaactattaaataaatataaataaactattccttatctttccccccaaacttacaaacttagctgcaccaataaaactgtcacctcttaagacccttctgtttaatcaaacacaaatccatccactatgttcttctgactcttggtatctctctcctgagctccagacttagataccaattgactatttaacatctccacctagatatctaataatcttattaaagttaacatatccacaatagatgcctttacttctggcctatccccaaaccactccaaccccagttagactcagtcttttttttttctttttttgagatggtgtctcgctctgttgcccaggatggaatacagtggtgcaatctcgattcactgcaacttccgcctcctggattctaagaatactcctgcctcagtctcctgagtagctgagattacaggtacgcaccactacacgcagctaatttttgtatttttcagtagagatgggggtttcaccatgttgcccaggctggtctcaaactcctgacctcaaataatctgcctgccttgccctcccaaagtgctagcattacaggtgtgggtccccgcacccggcctctttctatccaattcatcactcttctcctctatacctcgacttctttccctctctactactaccagtgtttacagcgtatagctttctaactgatctccctttttatcactgttctcactcttgaaagcattccccacagagcagcgggaatgatcttttaaaaatataaattacacatcccagaagcttaaaatgtgctagtggcttaatacaaatcttagaataagaatactgaacttactatcacttctgcctgtaatgcactttctccagctcatttaacaggtggttcattttgactttcagttcttacctcaaatattactagctcagaaagccttcctcagaacccccatccagggcagtgccaagtcaaaacaatcatattaatatgtatttccttcccattaataattacaagctgtatgtattttcatttatgtattattatttttttttgtctatattcactatctgaatgtaatctccgggcttcctgtcagttttattctctgcgatattcccagctgtgccttgtctgtaggcagtcaataattaacttaagtgaaggaaataaaagaagctcaatatggctgaagcacagggtacacacaacaaagtgtagggtagtaagattgtaaagacaggcaggtgtcaacttaaagattctatatatacaaggagtttgaaaggtaccctgcaaacaatgaaaagccactaaaggattttaaggacaaccaaaatacgatttgactaaaaaggaaaattgttctaacctaagtgagaatgactgatgagtagaacaactcttggcaagatgatgatgtgatgttcagtagccaagataatagctactgaaaactttctatgcacaggcactttacatgcatttttcatctaacttagaatagttacagagcaacattgatctgtctgattccaaagccttagctcataaagaccatatggccattaactaggttagtgagaataaagaataagagcaggtttgatggatgagattatgagctttcttttgagcaaaaataatttaagatgccaacacatccagactgtagtaggttaagaataagcagaaggtgaggaaaagacttttagaagtttggatattttttaatttttttctataaagaatctgacaccattgaagtttgactattttattaatttatttgaaataaaacagtagtaattagtaaggatgacagattgctgcatggatttgtctctgttttaagatgggagacttgttcatgtttacagtaagaagataatggaggtaaaaaggttgatatagaaaagaaaaagagaaaagaagttaagatgagatgagaggagcttaccctcctttaagataacagtgaagataatgaagacaggtaaagaataggatagattgacaagaaaactagattttgaggagttcacacctatgctttcattatttacttgtgaaataagaataaaattcacctaaaactggagtgataaagaaacggcacaggaaacttaagataaataaaaatctgggagaagaaacttatgaccgatatgttcaaaaaaaattgacagccaagcatggtggctcatgcctgtaatcccagcactttgggaggccgaggtggaaggatcccttgagcccaggagctcaagaccagcctggacaacatagtgagactctttctctaccaaaaataaataatttttaaaaattgaaaaaaaattgacaactcaggttgcagataatgcattggactaacactcaactgcctgaagaaagtggctggctggtctgaactagggttgtgtttggaggcataacacagtggaagtacaaagaaatgagaaaactgagggtacaaagcaagatagcagatgaattagcagatgatgaggtccagagtggatcataaagaaaatcaaggaaagggctactaaaaaacagagaaaagacagattccactaacttttataggaaacagagtagtaaactgagggaactagaaggtgaaattgtgatcttaaaaaatggaaagcattgccaggcatggtgtttcatgcctgtaatcccagcactttgggaggccgaagtcaggagttcgagaccagcctgtccaacatagtgaaacgctgtctctactaaaaatacaaaaattagccgggcatggtgtcgggtgcctgtaatcccagctactcgggaggctgaggcaggagaattgcttgaacctggaggcagagactgcattgagccaagatcacaccattgcactccagcatgggagacaagagcaaaacttcgtctcaaaaaaaaaaaaaaaaaaaaaaaaaaaggaaagtatcaaaaggaaggcatcctcttcttgattataatttataatttctttctctgagacacagtctcactctgttgcccaggctggagaacagtgacaccatctcggctcactgcaacctctgcctcctgggttcaagcgattctcctgcctcagcctccccagtagctgggattacaggcgtgcgacacacacctggctaatttttttatttttagtagagacggggtttcaccacattggccaggctggtctcaaactcccggcctcaagtgacccattggcttcagcctcccaaagtgatgggattacaggcatgagccactgtgccaggcctataatttatattatactttctacgagttaaagagtacaaaattttgaccaaaaccaaattttttctagtcactatttaaagtcaattttgtaaaaatattaaaactgacacttaccacacattgccacagactttgcctcttcaatagattgatgtttgtcagttaaacgagctttggttactttgtgttcatttacctcttgttctaaccgttgttgtaatgatttaagtttgtagtttaaatctatctctaaattattcttttcctgtaaaatgggagtaggagtcatgtaataaactgtgcagaaggcatgcatgttagtaaatcttacatttaatattctggaagagatatgatgccttattttaaaaatcacaataaacacatataattaaaagcaaaagataatcttttctttaccccctcccttcccatttgaatcattaatcatggcggagggcagaacaaggctgtgctggtggttatgttcaggacagttcattgctaagatcggaaatgaataagacaaattttcagtttatttaaaaatttctgataccatctttttttttcttttcttttttttttaaagagatgaggtctcactctgtcacccaggctggagtgcagtggcaccttctcagctcactgcagccttgaactcctgggctcaagctatcctccagccttagcctctggagtggctagtattacaggcatatgccaccacacctggctaatttttaagcatttttttgtagagatggggtctcgctccactgcccaggctattctcaaattcctgggctcaagcaatcctcctgtgtcagcctcccaaagtgttgggtctacaggcatgagccaccttgcctggcctgctaccactttaaaaaaatatattaaatcatctttatctacatttgcatctatatccacatttactttgctttcacaaaaaaacaaaaacaaaaaacaaacaaaaaaaccccacaaagtatcctgtggcaagtcattgatatagaaaggaaaaatgagtcaaaatatattccatttctgtttgggtacccttttctactcttcaagcttcttttatcctatgtccacatttacaccagcttggccatcaaaaactattctaattgtgacaaaacatgtccaaaggacaagataagtagtggcttttctgataatttacctgaggttctattgaacctccaacatttcagaggctttgaaaaagtgacagctgtatctctatatcatctatttaactcttagctaggtatataacagagaataaccaatgaaatttttattgttaagaaaattctaaatgcaaaggccaatcactttatgctcttttctattttgctaactgtaaaacaacagaacaggtactcatcatctaccacgtactgatctgttgttttccttcttcataagccctcacagcacattcatcttactcatgtacaaagaaaataggaaaacatactttataaaaaggtatttccaaaccaaaggaatctgtgatgatctgttaacatgaaacatctaatgctctctagggtaaaaacaaaaataacaaataacaaaaccctaaataagacatacatacagccccacatacaaccaatcaaacataaaaacttttagaaatgtaactatataaacattaagaataaatgctattttataaaaccacctagtagtctatgataatcagtaattactattttataataattggtatatgttaaatcatttaccttttctgagtgattaagcatgtcttgagcctcttttctttctccttccactttttcgagattatgtttgagatgcttcacctcctcttgtaaagatgtaattcgagctatcaagtgagaaaaaagttcaagtctgtagtcattgaaagaagtctttttgttcagtattgacaatttagtttttaaaaaatgtttttttaatgtattaagtttcctgatccgataagattttattaagtgttttcacaataaacacaagatatggaataaaaatattaatgctaattggatataatctagtgcatattccttatttacaagtagccaaagagatgaagcctcagcttgagctagaaatcagatccaagtccttactgagtgctttttttttgagacggagtctcgctctgttgcccaggctggagtgcagtggcacaagctcagctcactgcaagctctgcctccaggttcacgccattctcctgcctcagcctcccgagtagctgggactacaggcgcctgccaccaggcccggctaatttttgtatatttagtagagacggggtttcaccttgttagccaggatggtctcaatcccctgacctcgtgatccgcctgcttcagcctccaaaagtgctgggattacaggtgtgagccaccgcgcccggcactgagtgctctttctaaccacattaaaggtgagagcctttagttaattaaggcaagtattaagtggtccatatgtgccagacactgcaaagtgtttaataaaattacttttaaacttaatggagccaaactctattttcacagaaaactaagtttttaaggaattcaagtactctaacaaagcttagttttaacttacctgatgttcgtgccttgcaatggtagtaactcatatatttagtaattgtctactcattaaaacatgctttaaccttacaggtatttaaggcataaatatttaataaacacacaaatttaacacatgtagtatctgacttaatatattgtctagcttaaaataaaaattatattttcatattttgtaattcaaagtggcctaggatttgacaaggaaaatagatgaagtaccagatgggccagtaaaacttctgtactactcaaagtacagtttgacttactgtacttgtcccactctcaaatgtactctagtcacctcccatatttcagggtttctaaagtagttatttaataaacaaataaatattaaatctttggcacctgataatgcatatctgctagattagttctagatctagaaaacaatgaaataaataattttatttacacactcaagatattttcatgttgcagtaagttcatgtaggagaaagaaacagctgccgctttctttcaaataattgaccaaaaatacagagtatatgtgtgtttgtgtggacagagataaagcaaatgtgctaagatgtttaaatgttgaagtgctatttagaaattataatttaaaaaataaatgatataattatctttaaaataggccaggtgtagtggttcatgcctgtaatctcagcactttgggaggctgaggcaggcagattgcctgagctcaggagtttgagatcagcttagccaacatggtgaaaccctgtctcaaatacaaaaatcagctgggtgtggtgacacaagtctatagtcccagctacttgggagactgaggtgggaggatcgcctgagcccaggagttctaggagaaaatctgttttaaaaatcattttaaaaaatctgtacaaagatagtaattcagattaatctttgaatttttcatgtagaagcagcttactgcaaaccaactcctaaggagacaagataataaactatatgggttgaatccacgcaagattcctagcaaccacatgaaagagacaaattaagtatagtttattttcctcatttactctgtctgaaaagaaatgtcggaaataaactagaacttacctgtgcaatacacgaaagcaaagaagctttatatacagaaaatataaaaacataatgggaggaataagggcccaaacactaggtatcataatctaagttgattaaaacaaaatttctaaaagctaatagaagatattatcttcataatctagtcaaagactttttcgataggccacactaaaaaccacactaacaataaagaaaaaactagatacactggactacatcaaatacaagaaattaagaccttttgcttatccaaaagcagcactgaagagtgaaaatgttcccaccatgcagtagactgactatagttaacaataacatactgcatatttcaaaatagctagaagagatgattttgaatgttctcaccatagagaaatgacaaatgtttgaggagatgtacatactaattaccctaatttgatcattacacattgcatatacgtaccaaaacatcccataagtatgtacaattattatgtgtcaattaaaaataaaacagggggaggcagagaagggccaaatagaagcctccaccgattgtcctctctgcaggaacaccaatttgaacaaccattcgcacagaaaagcaccttcataagaaccaacaatcagcttagtgatatatatcagcttggccatggtggggtacagcaccaagcaggctcttgggggtccccaattccaggtcctggttcttggatggcatttctggacctgctctgggccagagaggagcccactgccctgaagggagagtcccaagcctggcagcattgagacccagtgctgtgctggcttcaggtctgacccagcacagttccagtggtggtggctacaagggtgattgtgtaacccctccccaccctctccctggcagctcagcgcagagagactccatttgtttgggagaaagggaagagaacagagcctctgcattataatacagataattcttccacatcttacccaaaaccaccaacatggttcctctaagagtctgcaagagccacagtattactgggcttcggatgcctcctaatacagatatggctacagtgaccaaaaacttaaatcacaacacctaagtcccttcgaatacctggaaagcctttccaaaaatgacaggtacaaacaagcccagactgcaatgactacaataaatacctaactcttcaatgcccagacaccaacaaacaaccacaaacatcacgaccattcaggaaaacataatctcaccaaagaaactaaataaggccccagggaccaatcctggagagacagagatataagacctttcagacagagaatttaaaatagctgttttgaggaaaatcaaagaaattcaagataaaacaaagaaggaattcagaatcccatcagataaatttaacaaaaagactgaaataagtacaaagaatcaagctgaaattccggagttgaaaaatgcaaccgacatactgaagaatgcatcagggtctcttaccagcagaaatgttcaagcaaaagaaagtattagtgagcttgaagacagactatttgaaaatacagtcataggagacaaaaaagaattaaaaagaatggaacatgcatataagatctagaaaatagcctcaaaagagagtatctaagagttattagccttaaagagcaggcagaaagagagataggggtagaaagtttactcaaagggtaataatacagaacttcccaaatctagaaaaagataccaatattcaagcacaagaaggttctaagggttcagaggtctgactcagcacagttccagggtggtggccatagggtaatggtaagtacactgaaaaacactactgtaacactgcaattgcagtgtataaattattcatatcttgggtagagagactaaaagaactgatcaaaaataacaactataatactttccaagaggcagtaagattataaatagaagcaacgaaaagttaagatgcaggggactaagttaaagtgtagagtttgtattagttttctctttgcttgtttgttagtttgttaatgccatcactgttaagtcatcatcagtttaaaataacgggttagaggatattatttgcaagcctcatggtaacctcaaatcaaaagacatacaacagatagatacccaaaaaataagcagcaagaaattaaaacctatcaccagagaaaatcatgttcattaagcagaaacaggaaggaaagaaggaagagaagaccacaaaacaatcacaaaaaaataacaaaatggcaggagtatgtccctacttattaacaataacagtgaatgcagatgaactaaactgcccaatcgaaagacatggagtggctgaatggaccaaaaaacaaacaaataaaaaaacaaaaaaacagaacccaatgatctgttgactacaagaaacacacttcatgtataaaggtacacatagacatacacagaaaaaacaaggggatggaaacagatattccatgccaattaaaacaaaaacaaaaacaaaaaaagagcagtagcagttatacttgtatcagacaaaatagatttcaagacaaaaactataaaaaggcacagaaaaggtcataatgtaatgataaaggggtcaattcagcaagagaatataacaattgtaaatacagatgcacccaacactggagcaaccagatatataaagcagatattgttagagctaaagacagggatagaccccaatcctggagacttcaactcctcactttcagcactggacagatcacctagacagaaaatcaacaaagaaaaatcagatttaatctgcactatagaccaaatgggacctcataaatatttacagaacatttcatccaacagccacagaatatacattctccttagcatgaggatcattctcaaggacagaccatatgttactccacaaagcaagtcttgaaaaattcaaaaaaagtaaaattatatcatgtatctatcttctctgaccacaatgaaacaaaactagaaatcaacaacaagtggattttttttttttttttgagacgaagtttcgctcttgtaccccaggctggagtacaaatggcgtgatcttggctcactgcaacttccgactcccgggttcaagcgattctcctgcctcagcctcctaactagctgggactacaggtgcctgcaaccactcctggctaatttttgtatttttagtagagacagggtttcaccatgttggccaggctggtctcgaacttctgacctcaagtgatccacccgcctcggcctcccaaagtgctgggatgacaggcatgagccatcatgcctggccaaaaagcggaatttttgaaacgatacaaatacctggaaattaaagaatatgctcctgaatgaccagcggattgatgaagaaattaagaagaaaattaaaatatttcctgaaacaaatgataatgaaaacaaaacatacaaaagccaatgggatacagtgaaagcagtacaagaaagcttatagctctgagcatctacatcaaaaaggtagaaaaagtttcaataaacaacttaatgatacatcttaaagaactagaaaagccagagcaaatcaaacccaaaattagtagaagaaaataaataataaagatcagacacatgcaacctaccaagattaaaccatgaagaaatccaaaacctaaacagacaaataacaagtaatgagatctaagctgtaataaaaagtcttccagcaaataaaagcccaggactgaatgactttactgctaaattttaccaaactttttttttttttttttttttttttgagacaggatcttgctctgtcacccaggctggagtgcagtgatgcaatctcggctcactgccacctccgcctcccgggttcaagtgattctcctgcctcagcctcccgagtagctgggattatagacatgcaccaccatgcccagctaattttgtatttttagtacagatggggtttctccatgttggctaggccaggctggtctggaactccagacctcaagtgatccgcccaccttggcctctcaaagtgctgggattacaatcgtgagccaccgcatccggcccttaccaaacatttaaagatgaacaaataacaatcctactcaaactatttcaaagaatagaggaggagagaatgtttccaaactcattctacaaggccagtattaccttgataccaaaaccagatgaagacacattttaaaagacaaataaacaaaaaagctataagccaatattcacgaggagcacacatgcaaaaaccctcaacaagatgctagcaaaccaaattccacaatacattaaaaagttcattcatcatgacaaataccatttgctgaaatatcattgttttagcaaaaaactaatttaaatatgttaaaatgccaaaataaaatataaaatttacaaaaaggcataatctacaaaaaggcattgagtcccaccaagaacatacaaaaattaaaaataaattaatgggcaagatataagaagaaaatgcacattaagaaaaagcctcagagtcagatacatttaatatcatttataatacaaattttaatccacccagaagatacaggagtcaaaatcttacacaccaaaaaacactgcattaaaaatatgtaaagcaaggtattcatgaaatacccacagctaacatcatactcaatgaacaatccaaaaagaaaattgagaaaattccctttaagagcatcaaaaagaataaaatacccaggaagaaatttgtatatagaaaactaaaaacaaacacacaaatgaacaaaaacactgctgaaacacattttaaaagatctaaataaatgaaaatatatccttgttcatggattggaagacttaatattagttttggttttttttgagacaaggtctgcctctgtcagccaggctggagcactgggacaacaggcgtgcaccaccacacctggctgattttttattttttgtagagacaggcttcgccatgttgctcgggggggtctcaaactcctgtgctcaagtgatctgcctaccttggcttcccaaaatgctgagattacaggcttgagccactggcgcctggctggaagatttaatattgttaagatggcaatactacacaaagtaatctacagattcaaagaaattgctatcaaaattctaaaggtcttgtttgcagaaatagaaaagccaatcctcaaattcacatagaattgcaaagaaccctgaatacgtaaaacatactgaagaacaacaaacttggagggttcaaacttcctgatttcaaaacttgctacaaagctacagtgaacaaaacaaaacagtgtggtacatgctggcataaggacaaacacacagaccaatggaatagggttgagaatccagaatatcatagatgcatgatatctatagtcaattgattttcttttttttttttggagacagggtctcactgtgttcgcccatgctggagtgcaatggtgcaatcttggctcactgcaaccgctgcctcccaggctcaagtgatcctccggcctcagtcccccaagtagctgggactacaggcacgtgccatcatgcctggctaatttgtgtatttttagtagagacatggttttgccacgttgcccaggctggactcaaactcctgagcttaagcgatctgcccagcgcagcctcccaaagtgctgggattacaggtgtgagctactgcacctggctgccaatcgattttcaacaaagatgccaagaccatttacacaggaaagaatagtctcttcaaacaaatgttgctgggacaactggatattagatgctcaatatcattagtcattagggacaatgaaaatcaaaacaaacagcaatgggacaaccaccacatacccactagagtaactaactgaaaaaaaggaaaataccaagtgttggcagggatatggagaaactggaatcctgtacattgctgacaggaatgtaaaatggtgcagccattgcagaaaacagtttggaaattcctccaaagttacacatagaattacaagatgactcagaaattccactcctaaatatacacccctaaagaattaaaaacaggtactccaacaaatacttgtacacaaatgttgaaggagtgctatttacaatagccaaaaggtggaatcaatccacagtaatattctgttatatgtatatcatcaacagatgaatggctaagcaaaatgtggtaaatacatataacagaatattactcagccacaaatgaatgaactactgacacatgctacaatatagatgaacctgtaaaacattatgctaagtgaaaaaagcctgacacaaaaggtcacacattctatgatgccatttatacgaaatatccagaacgggtaaattcagagacagaaaggaaattggtggttgccaggagatagtggagcggagaatagggaggggcagcttaatggatcctattttgtagtttcaaaatgaaatgttttggaaccacatagaggaggtatttgtgaacattttgaatgtagtaaatgctgttgaattgtatatttttaaatggttagctttttgttacaagaatttcaccttaattaaaaaatatagacagcaaaagctgttagaaatacaagggaggctgccaggcatggtggctcacgcctgtaatcccagcactttgggaggctgaggcaggcagatcacgaggtcaagagatcaagacatcctggccaacatggtgaaaccctgtctctactaaaaatacaaaaattagctgggcatggtggcgcatgcctgtagtcccagctacttgggaggctgaggcaggagaaccacttgaacctgggaggcagaggttgcaatgagccgagatcatgccactgcactgtagcctgggtgacagagtgaggctccgtctcaaaaaaaaaaaaagaaaagaaatacatgggaggctatgagaaaaaacccacaatgatagtgaaaacttttaaaacacattttaaaatttgacagaacaaagggacaaagaataaatgcaatcttagaaaactgatggattacattagaaaacggatcaacttttcacccaaaaagatgtttcatacaaaaatcgacaattttcaaatgcccatgtaacagtgaaatgcaaaaatcatttataaactaagccagaaaaaaaatcattaaaagtagaaatcccaaagtagaaatcttttaatagttcctgatcacaataagaaattattaattacaaaaaaaattgtttcctacctctgtccattaaaatcacctacaaacattgaccaacccaacagtagtgagcacccatagaattcaggttatagaccccgaatgtcatatgctacaaaaggaaccggagttcctaggcaaatgggtgatttcaggtctgggacaaaaaataattctggaaaatctatgcatatcaaaaagcaaggatgtgatctaaaactactagggtagtgtctaaacttaaagaattcctactaaacttcatgtgagcatcattaagaataatgcaaagggctaacatatattaaatatattaaaattcatgagttcacaaatatattttaaaaattcactaatcatctttggaggatgcctgggaaataactcactgttccaaaaactgacaaagaattaagtatttaacctgactttcttttataagctgtacctcaaagtaactactatataattgatgaggaaatgttcatctctagagtagtattccaattaacaaatgaaggaagatggataaaaatagatgatcaccactgcaaattcctaaagaaacaaaggacctaggcaatgatcatcaatggctactaacaccacaaaaagatacagccagactttatgttttttcattcgtttgtttgttgttgtttttgagacagggtcttgttctgttgcccaggctgaagtacagtggcacgatttcagctcactgcaacctccatctcctgggctcaagcaatcctccacctgagcctcctaagtagctaggactacaggtgcatgccaccatacctcgctaattttttattttttgtagagatgaggtttcgtcatgttgttcaggctggcctcaaactcctgggctcaagagatccacccacctcagcctcccaaagtgttggttttacaggtgtgagccactgcacccagcccagattttatgtttatgtgtctcctggtacctaaatactacttacaagtattcttgacaaagtcctaccgaagtagatcacatctctagatctaacgtctagtttaaagtactacggcggacagagcaacatgctaaatgataccagcagatgaaatcagtaaaattctgaacaggagccactcacaggacgaaaaaaacatggtttctttaaccgaaaacaacagcaaaaagagattacaaagaacacaaaagggaggaggaaaatacagattaaaataaacttaagggacgtattaatgaaatgcaatgtccaaactttggatccaaattcaagcaaaataaatgcaataagaacaaattatgagactactagaggaacttaagcactaattagatattttataatattatataactgtcacctattttctacctttgataatggcattgtagttatgtttgtctttttaaaaaagagtccctatctttaagataatgaaatatttacaaattaggatgtatttacaaaaggacaatgtggtgcctgatatgagcttcaaaataattcagtgtcagaggattgggaaggggaggtggaggtacaaaatgaaacacgactggctaccaaatgaaggtttttgaagcttaatgagtacacaagaggtcactatagtacaggttaggcatccttaattggaaaatccaaaaatccaaaatgctccaaattctgaaactttttgagcactgacatgacattcaaggatttcagatttgggatactcaactggtaagtatacataatgcaaatattctcacaaaccacccaaaatccaaaatctgaagcacttctggttccaagcaaacaattaaaaaaaacagaaaaagacttttaaaaatggttaatttaaaaaaattgatttttgcctttcaatctgaagaatcagagataaacttactagatgaaagcttatcaattcagttaaaatttcaatcctccataacattttgatcactttcattaagcctctatagcctgaacttttggaaactttccctataatcaattgcagccttactgttgcactagtccaggtactggcaaacatcagggctgcagcctgtttctgtacagatgtcaagctaagaatggtttttatactttaaaaggttataaaaagtaaaaaataaaaaagactatgcaacagagatcatatatggaggacattcaattaatgaataacaatcaagactctgccagaagcccaccatcccaaactaaatttatacttgagagacctgaaagttcttaaagaccagaaaagactaatataagcattgtgatttttttaaaaacccacaatgcacttttatatgtatgttgaaactcacataagttgtgtgcattattttagtgtatgtgagcttttattcacgtttaagttccaaattaaactctgaaaaagaataaactaacaataaatcatgctataaattttccttaacttttactgatatctaaaaaatagattcagttaaaaaccactgttgatagtacatggatgatctctgcctctgaagcaaggagcttaaagctcagtcaaacacagatcacaaacttataagaattttagaattggaaggatttatagaggtaacctattcttatctccttggtttacagataaagaagggagatgaagagactttcaaacagctaataagctgtataaaaaggcctaggaaaacaatttaaggaagtctgtgactttcctattacatataaagtggttactttcttagttataatcagatctattttaagcctggtccctgagaaatatgattgcacaacactcctcagctaagaaccaacaggagattgtattttctgtttccttagtcacaaaaactgaccctgacctctctccactgaattatagctaatcatcaagccccaagggacctgaaactatgttcccatctctaactaaggttaaaaagaactcctccctccaattttttcctgagacatctggcaacttctatgcatatttgttttgattaggtagtatggatgctgctgctaacaggaatagaaaatagaaaaatatgtgagtaggtaaagccaggaatctttttgaaaacaaactgaattttattactatttaaaaactgttcatttattcacttagttatactcaatcttctgcctcttagattcacaaagactgtcaatatctccagttcaaacattcccaagtatctaacttttaatgtgtaatgggattttatttctgcaactgactttctattactaccaacgatgcatgaggaattcctaggttttaatagtgataatcctctttgcctggattagtctcactttgagtaaaacctttatgaattaggcaagtttttaaatgaagtttttggttaatttgtctgtaaaactgaaaaatatccacattacataccctgcaggagtacctgtgagggtgaagaaattacaatgtgatacaaatgtgggcattattctaaaagagaaagaatgctggcctggtgtggtgtctcacacccataatgccagcactttgggaggtcgaggtgggcggatcgcttgagctcaggagtttgagaccagcctgggcaaaatggtgaaaccccgtctctacaaaaaatgcaaaaattagctgggcatggtggcatgcacctgtagtcccagctactcaggaggttgaggtgggagaattgcttgacctcaggagttcaaggctgcagtgagctgtgatcatgccgctgcactccagcctgtgcaacagagcaagttcctatctcaaaaaaacgtaaacaataaaaaagaatgcaaccatttctggtttcaccaaagtcattttctttatgagggtaatatgatcataaatatattaacttagacttaaaaatggtcaagatggtaaattttatgttatatatttttaacaattaaaaataaaaattataaaatattccttccattgatagatgagtggatgaacaaaatgtggtatacacataccatggaatattactgagccctaaaaaggaaggaaaatctgacacacacaacatggataaaccttgaagacattgtgctaagtgaaaaaagccagacgcaaaaggacaaacactgtatgattccacttatatgatgatggttgcatacattgtgaactgcatttaatcccactgaactgtatatataaaaatggttaaaatgttataataaatttcatgttacgtatattttaccacaataagaaaaaatattaccttgaaggtctccaatcatctcagaatcatgacctctgtctcttcgttcagcttctaatatagcttgcagctggtaataatctttgtctgtttgtgacttagaattctctaaaattcgatttctctcttgcaactctctgttcagggactctaactgactaattgacttgctcatctctgtgtgactcttcctcaatcttacagctgtgtccgattctgtcctaagtaagtcattggcttcttctagctatttaaaaagaaagcaaaaaaataggtttctgaccaaagtacgatataatttaattatctacaatttttttaaaaaggaacctcatttgaaacacttacctgcttttgtaactgggacagcttctcattagcaagctgtgaattctgactgactttctttaagtcttccaactgatcctttaatgtagaaactagaaaatgaaagaataatatatagaaattacaacattttcataggggaaacatataaatccttttttaaaaaaagacatttagtcttaggccataatagtcagctacattaggtccactcccaaagccaaattccaatttggaagtacctgcattttaaattcattaaaaagtagaacattatcttctaatacagagtgcaaaaagatttcttcttactgttgtaaatctcaaactcctttattccctttataagatcactgatagtatacttataaagctagttttaatattatttatttttcaagagttcaattgcttgataattcaatatcttaataaaaatacaaaatttaaaaggtaccaaatggtagatagtatagaataagtcctcctttctccatttagtcatttttgccccttctgagtctcccttaactggctctcctccctaatatatatttaatttaagcatatatagacaagtactcttgttttaaacacaagcaatccgtttctgtcacttaaagatctgtcttagagactgttttataaccgtatttaaggagatgatttattattttttataagccacatagtattctaccatatagatgtactaaaatttattacagcattcattacctttatgtttcatatatgtattacattatgtttcatatacagcattgactgcattttttttgtcattttaaacaatgctacaatgaatagccttgtgtatatatcagtttgcagtaggagtatgtacgtgaaataacttatggaagtgaaattactgcatcaatgggagtagaaaggtattttaaatatatttgtaacacaagcattaaaacacaagaaattctggtttagaagttcttagacgcagctgcttgttagaagtacctagggggcttgtaaagaataatgatactcaggccacatatctagaccaattaaattagaatcgctgggatttaggcatcagtactctttaaagcttcccaggagattccagtatgcacaccatgatgacaatcactactctagttaaatgctacttactatttactttaatatgtaatttaatatttaatttaattactatttaatatgttataaatttaacctgagacctgggttatttagcttataaagtgtcttaggattgtagcttcatgtatgtatcatggacactaaattaaagacaacctcatgacagtgttagaaattctatcatttttcaaaagtagtgacaatttaccttcattttctacatttcttctcttctcattttcctgttcagcttttctttggtactcattaattctatgctgtagcaacattttctccttctcaatctgagacactgtagattctagatttcttctttgatttccctggaattataatgataaaagttaccactgtgattaatactctggtcattcattcaagtgagtattttgttcttaaaaacaaaaaacaagaaaaaaaaaaagacaaacacttaagatgaatgttctgtttcaaacgcaaatagtatctcctaatacaactttctaagtagcttgccttttaagaagacagtgggaatctgtcttctgtagctgggactacagggacgcaccactgcgtccagctaatttttctatttttggtagagacggcttttgccatgttggccaggctggttttgaactcttgacctcaggtgatccgcctgcctcagcctcccaaagtactgggataacaggcatgagctactgtgcccagcctaaaatacccaaattttcacaacttaaaaatgtacctttctgagttaccactatcagtaaatcttgtttttgatgcttcactttttaagactccacattaggaaacctgttttacagtgtttctgggctttctcatctttaagcagaaattggacataaatcattcaaggtctttctgattctaagagtttatcattctaacttttagttaatttttagataattatacattcaaagaaagttgcaaagatagtacagagaggtcccaagtgcccttccactcagcttcccccagtagagacattatatataacaatagtacaataacaaaatcagaaaattctcactggtataaggagtgtatgattctctcattttatcacatatgtaggttcatgtaagcaccaccacaacgaagatacagaactggtcatcacaacaatttctttccagtcactagttatagccacacccatccccgtcctcccaccacccatactcctggcaactaatggttctccatttctataattttgtctttttgagaatgttatataaatggaaccatgcaatatatgactttttgagacaggcttttttttttttttttttttgtatttttaatagagatggggtttcaccatgttggccaggatggtctcgatttcctgacctcgtgatccgcccgcctcagcctcccaaagtgctgggattacaggcgtgagtcaccgcgcctggccaagacaggttttttttttttttaactcaacataaagaccttaaaatccatctctgtattgtatgtatctacagtttattccttcttgtggctgagtattccatggtacaaatgtaccgaagtttgttcaaccattcacctactgtaggacattttgattgttttcagtttttggctattacaaatagagctgttataaacattagtatacaggtttttgtgagaatatacattttcatttttctggaatacatgcccaagaatacaattgctaggtcacatagtaggcacatgtttagtttttcaggaacacagccaattggttttccagaatgtctgtaccattttatatccccatctgcaatgtccaagtgatctagtttctccatatccttgccagtttgctattgacataattttaaaacttactttttttcatggttatggagtaatatttcatgatagttttaatttgcacttcccaaatgactaattatgtgaacctcttttcataggtttattttcatccatatatctaaaaagtttaaaaagtatggattcgctttccttaacacttatatagggctactgaaattacctatttcacactgtatgagttgtgatagtttgatttttgagaagttagtccctttcatctacatgtcttaattgtgtttagaactgttcataggatttccttatgattcttttgatacctatatggtctatagtatatgccctatttcattcctcatactggtaatttgtgtcctctctttttcctttatcagtcttgctagaggtttgttaattttgttgatcttttcacacagctttttgtttcactgattttctctattgtttttctgcttttaactgccttgttctctgctcttatcgttacttgtccttccttttgcttgttttgggtttatttcactcttcttattctagtttccagaagtaggagtttaaattattgattttagacttttcctcttttctaaggtaagcatttagtgctataaattaaccttcatcaccatgttaacagcatctcacaaattttgatgatgtattttcacttcattgttcaaatattttgtaaagataaagagccataacagttttatgagacataattaacattccaatgtatttttttcactgagacttcttctttgacctctgggttatttagaagtttattgtttgctttccatgtgtttgcagatttttctgttattctcatctgtacattttggtcaggaaactgtatgatttcagtgctttcaaatgtgtttgttttatagcttgggatgtggtctaccttggtgtgtgttccttaagcacttgaaaagaaggcatattgtgctgttaagcagagggttctgtaaatgttgaacaaattctgacagctgacagtgtagttgagttctcctatgtttggtgattcttacgggtgctgaagtctccaacaataattatggattggtctatttaaccttccagtcttatcaacttttgcttcacatactttgtagctctgttgtttggtgtacagttaggatttttatttatttttggtggattgactcttatcattatgtaatattcctctatgttcatggtaattttctttgctctgaagtctactttaattggtattaacattgccaatatgctgctttctttttaatatttgttatgttatctcttcacatcttccgatgttcaacttgcctatattgttatatttgaagagtttctgacagatatataaatgggggatttaaaaaaatctacccctaccacctcttttgattggtattccatttaatttccatttaatgtcattattggtagtatgttagggttaagtctgccgtttttgtttttttgtttgatctctgttatttctacattttctttcctgtctttctgtgggttacctgaacattattttagcattccttttgatttaactatggtgtttttgaatgtatctccttgtaaggccttttcagtggctgccctagatattacattgtatatgcatagcttaatatatagtacactccactggtattggcatcttaccagtttgagtaaagtataaacatcttccctttcttcttttaatttttatcttatttatttttgagaaagggtctcactctgtcacccaggctggagtacagtggtatgcttatggctcactgcagcctcaacttcctggactcaagcgatcctcccacctctgcctccctagtagctgggactacaggcgtgcactaccacacctggctaatttttgtattttttgtagagacagggtttcaccctgttgctcaggctggtcttgaactcctgggctcaagcaatccgctggccttggcctcccaaagtgctgggattacagacatgagccaccacacttgacctaaaaactttacctttctttatgacccattactctctgtttataatgtctaaaatattttttctcatacacagagaatcatattagacaatataatttctgcttcaactgcctactataaaaaataaagaggagaaaaaaatgtatttacccatcttttactgtttctttattcctggtaattcaaaattcctcctttttcttttggagacagagtcttgctgtgtcacccaggctggagtgcagtggtgcgcttggctcactccaacctccacctcccaggttcaagcagttctctagcctcagcctcagcctcctgagtagctaggattacaagtacacgctaccacacttggctaattttttttgtatttttagtaaagatggggttttgccatgttggccaggctggtcttaaacttctggcatcaagtgatctgctcgcctcagcctcccaaagtgttgggattacaggtgtgaaccaccctacctggccaagattccttcttttatcatttcctttctgtttagagaattttcttttgcaattcctttagggaaggtgtgctggtgacacattatcttagtttttcctcatctgagaatgttgtcattttctttttcatttgagaaggatgttttaattgaacacagaattctaggttgataggtttgtttttttgtttttttagcacctgaaaaagtcatgccacttcctcctggcctccatggtttctgataagaaatcagctgtcacttacactgttgtttcctttctaggtaaggtgtgtcctgtatttaagatttcttttttgtcattaattttcagaaatctgactattgtgtcttggtgtggatatctttgggtttacactttttgtggtttgctaagcttcttggtagttcatgtcttttgtcagttcaggtcttttgtcaaatttgttgaattttctgtcgtcatttcttcccacgccctttctcctctcctttagtaattcgagtgacacaaatgttagaattttattgttatagttctacaggtcccagaggctctgtcactttttttctgatcattttctctctgttgttcagactgcataatttctatttttctttgttgaaggtctctgattcgctcctctgcattgttcactctgctgctgacaccatctattgagacttttatttcagttattgtaatttttggttggctctattttatattgtctatgtctttctgagactatttttttgcttgtttgtatgtttacagttgctcactgaaacatatttatggtgattcctttaaatacttgtcagataactctaacatctgtgtcatctcagcattggtattagtttattattgtttctaattccagttaaaattttcctagttctgattatgatgagcagtttgctattcaaacctggacatcatcttacaacattctggatcttatttaaaatctcttttagaaggtctcctctgacactgttctggtgaaactaagggggtgctgcctcttttctgccaggtggagtttgcagaagtccaggttttccactcagcctctactgacacctcaggtagggaggggagcagatcctcatcactgctgggtggaagcaggagttctggcactctaccaggcctccattgagtgcaccatggctgctccttatgtggcccccacagatgacactgcattgtggaggggagcttgttattttcagtggaaagttctgactccctaccatgtctctttgataccaacccagaaggcagtgggaggggcacccccttactgccagctggaagtgtaagtgtagattccccacatggtcactgctacgctgtctggggagagaaagaaggtttgttactgcccacaggagatgaaaattcctttactggaccttctctgacactattctaattggaagttggggtgtgctacagcatagtggagatggaagtctagacttcccactcagcctttgctgttaagaatggggctacagttggctgggcgcggtggctcaggcctgtaatcccagcactttgggaggccaaggcgggtggatcaaggtcaggagattgagacaatcctggctaatacagtgaaaccccatctctactaaaaaaaatatataaaaaattagccaggcatggtggcgggcgcctgtggtcccagctactcgggaggctgaggcaggagaatagcgtgaacccgggaggcggagcttgcagtgagcagagatcgcgccactgcactccagcctgggaaaaagagcaagactctgtctcaaaaaaaaaaaaaaaaaaaaagaatgaggctaccgtttttctgtggtgtttggctgaaaagagcagtgatagtgtaagttttctgacttgctagcctgctccttttttggtctttaggctaaggaaattagctttttttggagctttgtctgcaactgttgatatttcgaggttgctggcttctccggcaccccgtctaggatacatgcagcaaaaagaaaaccctgaagactcattcatgtgttgtttctcaggacgcaagtaacccaggttggtctgccttctttccacctttcaaaatcttttcatgtttgttttatgtttaatgtttagggtttttagctgtacttactgggaggaatacagaaaaggtactcttactccatctttctagaagtgagactattttaatttcatacctcaaatttccctctctacttctaatttggaaaaatgaataacttaaatctagcacatctgaattttatctgtgttttaaaagttaaatataagtggaagatatgcaaaaaaggactccttaaacactcagagtcaaatatatactgctaaggttaagtacaaaggcaagttagtaaatgctctctaaatcttcatagatatccaaagctacccatgaaagcaagcaagccattgacagataccattctataagggaagaaaaaattaacacagcataaaaactatcagagattaaacctaaaaaaggacaaagtaagtaatgtattaggagaagactacagagagtgtatttcttttcatgggactcatagacacagtagaaatatacttagaagttgactaagaggaatggaaatgtattacatatttgcaaacaaacatctgaattatgaatgcttgttattgtttctctgataataaaaaattttgacaggtaaccatggaaaagatgaacattctaaaatcaatatattttccatttgattacatgagattatgtcagtgttaatcttttaaaaatattttaaactgtatttctctcttttccttatttgtctgtctctttctgacatagtttgagattcaatttctgatcgcttgcttctctggctcctttctcacatttcaaccatcgagaaccactgaactgaaatttacgtactaaaattaatacggctgtagaaaacaattgtacaaaggaaactaaattataatctaatctgtaccacttgaaactgcagttccaaggtgaggctttcatcacaattctctgctctgttttgtgtttcaaactacagaattcaaatacaattttctcaggaaacgaaacaatttgaaagagggaaaaatctcaaaaaggaaacttgattagaaaacaaaaagtacctcttcatccaattctttcattatcttgtctagttttatgtttgaggttctgtaaaaacaaaagcaatacagattagaaatatacgtatttcttattgcccagtgttaaacactaacattccttacttttccacttaactagagttttgtatcctttcttggtgccatggatctctttggcagtcaagtgaagcctatggccttttttcaaaatattttttgaagcacaaaaattatatatgattaaaagagacaattaggctgggtacagtggctcacacctgtaatcccagcactttgggaggctgaggcgggtggatcatctgaggtcaggagttcgagaccagcttggccaacatggtgaaaccccgtctctactaaaaattaaaaaaaaaaaaaattagcaaggcatggtggcgggcgcctgtaatcccagctatttgggaggccaaggcaggagaatcacttgaacctgggaggtggaggttgcagtgagccgagatcatgctactgtactccagcctgggtgatacagtgagactccatctcaaaaaaaaaaaagaagccaattatattgaaacacagtaataaactttaaaaaaatatgtgtaattcagtagtatatatgcttccttattaatatattaaatcacaacatctagtggcagtgatttcaaagtattgatgagcataaatgatatttagagatagctgtaacaactgtaataagaaaacatctataatttctattggtaataaaaattaacaactactgctaataactgaattgctgcctatgctcagaattgaaacaagtgctaaaattaagttataagttagagaaaacgttcaccttttgtcatccacgtttaaggacttcaaatttcatccatggactctttgggggaggtctatggatttcaggttaaggatccctaaactccgtcatgcaatacttgccactactcaaaaattagccatttatcctttaatacaggataaagtaaacaaagagaaaggtagtatatatcaaatcagtaaaggcaccatttggcaacactcaaagtgtattatcttcattaccatttgctttctttggttcaaaatgtaattctgagcttcaaaacctatatatgcaacattttcacgtggatgtctcattaaatacctcattcagcatctccaaaatagaacttactgcctctgttccacactcccaccccaataccaatttgcttctcttctagagtccctaagtaaatgacaacacctaggaatcatccttgactcatcctccctcactcccatttagctgaataaagtgccaagtgctgctaattaagcaggaacttcttttgaaaacagcaaatttaatatatattttttacttattagtttaatgacttttgatgtttttccattacacttaaattccaaatttcttagcccccccgcaaaaaaaaagagaaaaaaaaattctccccaatctagaccttgccatcctccccattctcatctcaggcttttccttccctcacatcttactggccagtcaaggtctcttacctcacggccttcacagatactcacctcctggaccctaacacttccttccactcttctcctaataatttccattgactcttctggtttagctttctctgatctctgacaaaacagtacaggcatctcctgatgtattcctgatattcctgtataattttattctctccccaattaacacataccacacttctttttttttttttttttttttttgagatgaaatctcgctctgttgcccatgctggagtgcagcagcgcaatctcagctcactgcaagctccgtctcccgggttcatgccattctcctgcctcagcctcccgagtagctgggactacaggcgcccgccaccgcgcccagctaattttttgtatttttagtagagatgtggtttcaccttgtgagccaggatgtcttgatctcctgaccttgtgatccgcctgcctcggcctcccaaagtgctgggattacaggcatgagccaccgcacctggcctaccacacttcttgataattacttacttgtttttcttgctaaattacaagctccttgtggagaggggccatgtcgtgatttattcagtactatattgttgacaagcacattatatgacactttaactgaaatttttattgaataaatgaatgtaactaaaatgatttgaatgcagagaatttgatttaaagaaatgcaagtggccgggcgtggtggctcacacctgtaatcccagcactttgggaggccgaggtgggcggatcaaaaggccaggagatcgagaccatcctggttaacacagtgaaaccccgtctctactaaagaattcaaaaaattagccaggcatggtggcgggcgcctgtagtcccagctactcgggaggctgaggcaggagaatgccatgaacccgggaggtggagcttgcagtgagctgagatcacggcactgcactccagcctgggtgacagagtgagactctgcctcaaaaaaaataaaaacaaaaaaaaaataaataaaataaagaaatgcaagtaaatatcactccacaatccctagcactaggtttttattttaaaaactatttaccaattcaatatataattttttaaagtttcatctcaattttatttccttgaggtgatactttcatatgattattagccaattcagccattcttattacttcctcaaactgatccctactcaccattactaccagtttgtcacttgtcttttaattttgtttaaaaatttttttgggccaggcacggtggctcacgcctgcaatcccaacacttcgggaggctgaggtgggtggatcacctgaggtcaggagctcgagaccagcctggtcaacatggtgaaatcccgtctctactaaaaataccaaaactagccaggcgtggtggcaggagcctgtaatcccagctactcgggggactgaggcaagagaatcacttgaacccgggaggcagaggttgcagtgagccgcgatcgcgccatcatactccagcctgggggacaagagtgagatttcgtctcaaaaaaaaaaaaaaaaaatttggatgtagagacttcccaacatttatataacagtatctacccagttcttccccttatttacatattttatacttagaaattctttccaaatcctggggtcagttaattatttgcttatattcaaatgcctttttaaaagaaatttgtattatacacttaaccacataatctatcaggaatggttaaaagtgagaattttatctgttttgtaccaaaccccccacctgctctgtcacaaaattaccagtgttcccaattttatttgttgaatacttttcgtgttacctttgcatttcatttattcaatactattcactaaaaacataaataattataaaaaattattgcttataattgataagtaattcagtattatgctaggtaatttaaaataaacgtgagcataactcaaagatattttttctgtgagtctaatgacaataacatgctgaaattagacccacagaaaaagatactctgagttactgctctggtgaaccacagtggaaattagaatggccacatcaaaaatttagtatattttaatcttcaacattttacatttcaaaaagcacctgatttaatgtaaactaatttcccctttatttatttttctttttgagacagagtcttgctctgtcgcccaggctggagtgcaacggtgtgatctcgacttcctgcaacctctccctcccgggttcaagcaattctcatgcctcagcctcccaagcagcagggactacaggggcacaccttcgtgcccagctaattttttgtattttcagtagagatgcggtttcgccatgttggcctggctggtcttgaactcctgccctcacgtgatccaccatgtgcagcctaatttgcccttttagttagctaattatgtaaagagaaaaaagcagtaagtcaggcaactaaatgaattagcattacagttttttaagaatacagactgttggccgggtgcggtggctcacacctgtaatcccagcacttttggaggccgaggcgggcagatcacgaggtcaggagatcgagaccatcctggctaacactgtgaaaccccgtctctactaaaaatacaaaaaaaaaaattagccaggtgtggtggcgggcgcctgtaggcccagctactcgggaggctgaggcaggagaatggcgtgaacccgggaggcggagcttgcagtgagccaagatcgtgccactgcactccagcctggacgacagagcgagactccatcttaaaaaaaaaaaaaaagaatactgctttactttctgatgactgtaatgaaaacacagttggaacatattacaaagtacacaatatattattttcatgaattaaaaaaaaaaaaaagaatacagactgccaggaacaaatgtactttaaatattctgaggaaaatacatctataactaagccaacataaatacaacttctcaattctagccgagacacatcatgaatgtattatcagtagtaatctttacatcctcattttctatttactttcagatgtttacagggtataagctttcaagtaagtatttggtatataaaacttttaatatgaaaaacttaaagtatattctcacctgcacttctgctccatttcatcttttaactgcatttcattatgcagctgttcttccagcttatagattgttttttgcaaactttcctgctttaatttaaaacaaaaacaaaaactcattctactaagaatatttagacatttaaaaatatcaagtctatgttaatattttaaacctttttagaaaataatttaatttaatcttacctctttctatctcaatttttttattattaatttaacaagcactttcttaacatttactaaacgttaggccattagaaatacaaaaattaaaaagatttggttcctgttctcatgaagcaaatagttacatagtgaggcaaagttaaattggaagagaaaaaagaagctacaatgtcccaaagacatatacacaaaatattacaatagactgtggtaaataataaaaaaattatctacggagtgttccaaaggagagaaaaggtcacttctaactctgccaagaatatataatccttgagttgaggcctaaaagataagaagaactgataatctgataaagcaaagaaggtggcacaagaaaggcattttagctagaatgaacaatgagcccaaaagtagaaaggcagaagaaaatatgatatatttgggaaatggaaagaaatcaagtactatagcagagcacagaatgtaataggaaaaacaactcacattaagcctaagaaggtaatgatccttgtatgcacaaactggagttggggactttaccccataagcattttaaatgagaaatgacataatactggcacctcagaaacatcactacaataataaggttaatgaacagcttagagggcagtgaagttctaagaagagcaaccagttaaaaagctatcaaagcagttcagacaagagaatatggatctgataaaaggcagaggctacaggaatgaagaggaagtaatggataaaggtatcaattggaaagcacaatgtatgaccaaaccgactggaagttagaatagatataataccattatgaaagacagccaacacactgctagggagggaatggggacaggaaaacagtgagtttagctctggcctagtttgatatgcctgagaagtatacagaagagagagaaagattcaggactggagctcagacaagcaagctggacatgaatgagattacctacagagaaagagcagagagccaagatcagaactttgggaaatgttaataattgaaagtgagcagaggaggaagatcctgaaaagaggattgaaaaataaataaaattcaaaaatatgggaggtaaaaaagagggaaacaataggaacatagaagatttagaaatgtttgaagttccaaagaagtaggaagcagtcagtgtcaaatacagcaaagaagaaaaataagatatgggctgaaaatcatccactgtatttggcaattgcaaagttgttcaatagcatctctgctaggttttcaaggaaaattaaattagttgattttgtacttagttctaggttgaaataattagtatatcccccctgatattattagagcaaaagataaaggtagcaaccactgataaacttatggtaatcaccactgaacaaaatcagcccaaagaaaacatgaatcctttgaatatttttgaaggccgaaggcacttctaactctacagtcaagtaacacagtgagagctgacttacagcaactccttattattacgtaggtcaaagatttttgagcccttgttagcaatacataacttgccaaacagctctactgggattaaaatttaagagaaagatgaacttaacaccaaatgagtactcatatagttccttcacctttttctcattttcccttttcaccgcatgttctcttatatttaagagtcaatatatcaaggagaaagaaaagaatcattatcagctttttaaaaatggctgctacctcttcctctcctctgttaaaaatatgtaggcttgcaatgtctctgtgcccccccacaaaaaaatgtaggctatagtagacaaaaagttcaaagaatgctctaggaatggacagataattactctggatatttttcagaaaattcctgttaacccaaaaggaccttctgaaatgtaagcaagtaagattttgttttacctctgtgtcagaacatgagctatataaacaacagaaagaactcaactaaaatgtattttctggagtaatatacttctcagtggacaaattaagatgatgctaactatactggttattctccatttcccccattcccttctaaccttgaaaattcatcctctgctcttctttgccttaaaatctacagattgcattgcctgtattactctgtagccctatgattttaaggttggtttcaacccacaggagacaccagcagaaatctgaaggtaaaagaaagaaatattcatttccctacaccctttgtgctttactgtggttttcacaatgctctacgttttatattcctcttctatgatgtcaggctttctctgagctacgataagattttctctctttgctccttcagtatagggcaatggcttcccactcttgttcatacatgggtgctttagtaccctttattgtttccctctactgatgttcacagcatgttaatcatcccttcattaaactcttgatttaataaatgcaaaaatatggtgtgtgtgtatatatgtgtgtgtgtgtgtatatatatgtatgcaatggaatattactcagccttaaacacgaaggaaattttaatatatactacaacatggatgaaccttgaagacattatgctacatgaaataagccagtcacatatggataaatattgtatgattccacctcatatgaggtacctggaataggcaaattcattgagacagaaagtagaacagtggttaccaggagctggggggagggtgaaatgaggagttactgtttaattggtatagatttttagtttgggatgatgaaaaggttctagagatggatggcagtgatggctgcacaactatgtgaaggtgcttaatgccaccgaactgcacacttaaaaatgattaaaacggtaaatttcatgttacgtatatttgccatacacacaaaactctctgtttaaatattttgaacatgtaatctgtttgcctgtcaagacccttaatgatacattgatatatcatagttcctgattccgaagattaaaaaagatgaccactgtcaatctgtgtaacaatttagtttactaactgcctccaaatatattattccatttgatatttgagcaaaaaatcagactgaaaaggagatgggagatgaaagtgccataaaaatctaagttcagctaaccacagcttcacaaacaatatataaatttactatcatacccacaaatatattatccacaaaacaattttaaaaacaattttcttaatactaagaaaatacctaccaagcttttatctgcattggagctagttctgttatcattaggatttgctgaagataagtatctgagggaaagaaaagtttaaaaagaaaagaaaacaaaaaactctgtaatatcccatgacaaccaataataaatactacacgcctattttatgttcagttatagtaactttgtttttaaaaattaagtataggttcataatttttataaacataattcagaaatgatacatatattaaataaaacacccagttaggtctaaaaatagtagcagcctgtaaacatatgacttaatattcctgcagcaaaacataagaatattcataccaagtaggataaataaaaaccatagtctcaagttagttcagattaggctttctggtcatgagagcaggttatgacaggtttttccaccaaacaaataacttaaaaacattcagttttcagagctttttgtatataagaattgggggtaagaaactgctgacttctgcagacatatgcataaccacctctcctgcacccaactatccttcagcaaagcataatattgcctcttcgggtcaaaaaagtttttgcctatgtgggtgaaataacagaaccaaagtttaggtgatgctgctaatcttttgggactcccagccttgcagagttctttaaattcagtgtaaagttagaattgtatataaataaagctattagtgaactaatttagaggtcttttttagatgtctcacaagattctcaaacaatctaaatagatcatatatgtaaacaattttttaagctaccaaatattatataaaggtaaggtactagtactgccagtgttgctcctactgccaccatgctacgactaccataatcactacttctaccatcaccaccactacagtcagcaccctgattaaccagtagagctattgcaaaaggagatcaaatagttacagtatacttcatagctattggaggcatgtgttaacacaccagatattaataatgttccaaaagaacagtttaagtaaattttaaaaattagtgaataacagaagataatcaagtatccattaagtatcaataaacatacacagtacaatggtactataaaagaaacagctagaaatatgccacttcctaggttttccttgaaaaattattcagatcaaatggagattcaaataactttaagacaataataggggctgtgtagcagctttatagaggaaaagtcccatataacaaatgacaaattctaggtgtggtgcaatttaattccattgactactaagcatctcagaaattcaatgtgagattctgcttatgtaatataaataaggcatatagcaatgccagtggcatctaaattagatgagactgtttcatctctaagatattttctaaacttaacatgctatgtgactgagactgacattttagtcttctgcaaaattagtaatataagcttgaatgcagcaaaggaaatgtaaggacatcacttgtatacatccattaattcttccaccttctgtcttttctctatcaaggtacatttgcatattatattggtgcttttacatagaatctggtcatttaggtaactttttacaaaacgggagttactatattaggaatatagcttaaggctattttaaaaatcatgtttaattcagctataattaagcaacaatgatttctgcccttggtattaaaagtatatctggatttcagggataagaatttcagaggttttctatttcatatctgtatattcaaaattatgcttacatattacaataaagctaatcaatattttgccagggccaggtgcagtggctcacacctgtaatccgctgggattactttgggaggccaaggtgggtggatcacttgaggccaggggtttgagaccagcctggccaacagcctggccaacatggcaaaaccccatctctaataaaaatacaaagattagccaggcatggtggtacgcacctgtaatcccagctactcagaggctgaggcacaagaatcacttgaacccaggaggcagagattgcagtgagccaagatcacaccaccgcactccagcctcagcgacagagtgagactcttgtttcaaaaatatatatatattttgttggttctttctttatgaacagcaaccgtacctttgcctgttcaggtagtaagtgattacttaaaaaatactatatttatttgtcaataggctgtgacagttaagaacacagtataatttctacttttaagaaacttaaaaattagtttgggccataaaacatgaatacgaagaaaagctagagaacataatcaagtgcatgataatgtaggacaaatagtataataaatgtttatttaactgaaggttaccattatacagagaaacctaaataaagttattaactgctggactctactacagaaaatacaaaaacattggcggttgtttatatcaacaacttgagtgtttcagaaaccaagtcaaagaataattgataaaaatacaaaaagttaacacttcagcaggctgggcacagtgggtgacacctgtaatcccagcactttgggaggccaaggtgggcggatcacctgaggtcgggagttcgagaccagcctgaccaacatggagaaaccctgtctctactaaaaatacaaaattagccgggcatggtggcacatgcctgtaatcccagctactcgggaggctgaggcaggagaatcgcttgaacccaggaagcggaggttgcagtgagccgagatcgtgccattgcactccagcctgggcaacaagagcaaaactctgtctcgaaaaaaaaaaaaaaaaaaaaaaaaagaatgcttcagcaaaaaccaccctgaagctcttctgtatatgtatgttaattgaatacagttataatattatactcacagagtgttagggaggaaaaaaagataagtgccagctatctcattgatgttgcaacaaaaagtattaagtactatcttacagtggattactgaagaagtttcaaaaagccggactaaattgtctttttgttttctaagattaacttgaatggctcttacactaaaatgacaagacccttcactttaaaataagattagttataatgacctcaaatgtaataatttactccaagccaatcagttatctgataccattccaaaggagtataatttgattagaagtacatatttttgaggtaattaaaagtagatttaacccacccagtaagtgttatcatatagttcaatgcattatactggtatagcactttgtttagatttctttttctttctttttttttttttttttgagacagagtctcgctccattgcccaggctggagtgcagtggcgtgatctaggctcactgtaacctccgccccccaggttgaagcgattctcctgcctcagtctcccaagtagctgggattacaggcatacgccacgacacctggctaatttttgtatttttagtagagacggggtttcaccacattggccaggctagtcacgaactcttgacctcaagtgacctgcccaccttggcttcccaaactgctgcgattacaggcgtgagccaccgtgcctggccgagatttctactatgtagttcttactaacctacattgcacaatttatgcatttctcaccaagatgtgagcatctcaagagaaggcactgtatcttattcatccttctccatgcaatttggtgctcagtatatacctgacaaataataagttatcaaagatatctgtggaatgaatgaatgctcagcacactaaaataatgttaaatgtttaacttaaatctcaagtacattagagtaaagctaacatgaactcatactaatggtaataatagttaacactgagtgcttacaccatgcaaagccctcttctaagtgctgtactgtgttttaatttacttaaaccttataacaatcctatgaggtaagtaggcaagcagtattattgttattatcatcatccctatttttgaggaaatggaggcataaaaggccaaagttatttgtccaaggtcacagtggaggtaatactacattttataacacatggtaaaatttggggaggaatcacttaatttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcaccgtgttagccaggatggtctcgatctcctgacctcgtgatccgcccgcctcggcctcccaaagtgctgggattacaggcgtgagccaccgcgcccggcccacttaatttttgaagagctaaaaattgatacagcatcaatatggtgatgataatgctagaaaagtctacatgctggccaggcacggtgggtcacgcctgtaatcccagcactttgggaggccgaggcaggcagatcatgaggtcaggagttcaagaccagcctggccaacatggtgaaaccacatctctactaaaaatacaaaaattagctgggtgtggtggcaggtacctgtaatcccagctactcgggaggctgaggcaggagaactgcttgaacccaggaggtggaggttgcagtgagcaaagattgtgccactgcactccagcctgggtgacagagcaagactccatcgtggaaaaaaacaaaacaaaacaaaacaaaaaaagtctacatgttgtttcaaaatgtattataaaccataagtctacagatcaaaatatcagtatttatggcattttttgacctattaattgttgtaacttgaggatatatagtatatcatttagcaaaaaaattttgaaaaacaatgtcctaaacatggatgagtccaagagaaattaaatatgaaatactggaaatatcatgcatcaatgaaaaattgcataataaggtgtatctttatatagcattaaatctactttaaaaatgatttttagatatttctaagaacaaaatcagcacttactcctataatcactgtttagcatacttacctacgattgctataatatgtaaatcctacaaaaggtagttgattgccaacgaaagctttaggaatagggaatgtttcttcctctcctttatcttcttccaagtcatcaaaattactagtatcaatgtcactacttaaatcgggtacaactggtgctacagctaaagacaaaacaaaattagttgttcacttcaaacttaaaatacaagtaaagtgaagcacattccataccaactactgatggtttctctcttataaaaccttgcaaaccacaaattccacctggcttgaatcctattacatcaagctttaccaggactaaaaatcaactgataattgatcattatgtaattctatgaaacaattatcttcaaagtcacctataattatctataccttgggtttaacttgactattacaaatcaagtattactaaggtttgttttagaatgtaccaaggtataaaatacacaaaagcattcgggactacagaaaagactttttagaaactaaagcataacaaactgtactcgaaaaaattgtttagctttaaatatagtattttttggttaatctgctgtatagtaaaccagaaattaaggttacttcttagcttcctggacatcataatttggtactgaaatatttttactcactcagaatccagatgatcaatactcctttctcccaccccaatatctccataagattaagccacaggagcaatggatttggaattgtattttcagactagctacctctagaatcaagtgattaagactaatgcagtgaggtatttatgatatcattgttaataaaaaagggcagtaatataaaaaatggatatgacatcttcaagaattataaatttgatgtggaccaagtcttccagatacttaataatataaaaccgtatgtgacaacgtttaaatattcataatataggagaaaattccatataaaactaatactactaacatctatttttggggcttgaatgttacaaggggtacatctaaaaataaattctaagaaaataaaattttaagaaaatttattttttagcttaaagatactgtagtataataaaacatccctgaattatgatcatcaaaatactaaaaaattattttaggtacaataacctcatgttcttttagggaaaaggaatcaattttcttttcaatcacctgggtatttcaggcaagaaatacctattcttgtgccatctgagacacagtaaattaatatttagggaacgaaacaacacatttagccaaatgaagctgtagtactaacagtaacacaagagggatattagggcttttccaccattccactttccttaatggccaacagaactgtctgattagacatggccagctttctaatatttgtaaaatgaggtgaaaacactaaacagttgccgcccttgggaaatacagaagttaattatggtcttggcatacattttatgttaaaagagtgatctcaatcagagacacttttgcctgctggaaggtgttcagcaatgtctgggtacatattctggttgtcattaatgggaaaaaaggtgttactagcacctaatgagtacagtcataggatgccactaaacatccttaagtttaggataatccccacaaaaagaatgatctgtcaactgctaaagctcagaaaacctgctttaaaattatatcagaaagagagaacagagtaagtgtgctgcattttctcttgctgtttctgatggacctactctttttataaatgacactatttcacagtagttctaaaatgacaaattctcacctgtttaaattctgagatacaagtggggaaaatattggaagagttataaaaataattatttctgcttctaaattaagatgcttaggctttatataatgccatttaatcacttcagaactaataagaataaagataactatggaataaacatcagtatatatttgtttaaaaatttgttttcattaaataactgttaatttagaaatcatgttccataaaaaagagtccagcagatgttgtcaaaaatggcagagtagggaactcaaagaaatcatacctccactgaagcaaccattgagttggcaaaaacgaccagagcaactttctgagaactctggaatctaataaaaaactaataacaagcaaggagtgtttaatgaagaaagaggctataaaaatttggcatttaaggaaatctctgtcactggctgagataatgaaatggagatttcagtgaatacacatgacaaggaatacagattttgcaaaattagtttggaaaagtcactaaatgaatgaatgactgcagcccacaacaagcaacaaccgcaagccctgggggaaagaggaagaatctgatttccagagttacaacactgtaatatccaaaatgtccctcttagaaggatacagctgctttaaaacaatgtccagtttacaacaaaaaattacaaagcatgtaaagaagcaagaaaatatgggccattcacagggaatatagaaaaatgttagaaaccaccaggcgtggtggctcacgcctgtaatcccagcactttgggaggctgaggcaggtggatcacaaggtcaggagatcgagaccatcctggctaacatggtgaaaccccgtctctactaaaaaatacaaaaaataagccaggtgtggtggcgggcacctgtagtcccagctacttgggaggctgaggcaggagaatggcgtgaacccaggaggcggagcttgcagtgagctaagatcgtgccactgcactccagcctgggcaacagagcgagactccatctcaaaaaaaaaaaaaaaaaaaaagaaaataatatagaaaccacctctgaggaaaccaagatattagatttactcaacaaaatcttaaactctcttaaatgtgttcaaaaagcaaatgaacactatggatgaagtaccaggaagatgatgacttaacaaagaaaaaatatcatgaaagagatcgaaaatagaaccaaatagaaattctagcactgaaaagtacaatagctgaagttaaaatttcactagaaggcttcaacagcagatctgaacaggcagaggaaaaaaaaccagtgaacttgaagataggacaaatgaaattatcaagtgtgaggaacagaaagaaaaaggatgaaaaagtgaacagagactaaggaaactgtggcatcaaccagaccaacatacacattatgggagttccagaaggagagaaaggggcagaaagactatttgaagaaataatggccaaacctttccaaatctggtaaaagatataaatctacacatccaagaagctgaatgccaactatgaaaaactccaaaagctccacatgaagacacatcataatcacatgccataatcaaactgtcttaactcaaagccatatgaagaagaaaaaggagtatcagtaaaggtaactatttagataaatgtaaacagaagcaggtttttaagctactcaaagtaaactggtatcaattcaacctagattgttttcaatttagaatgttaagtgtaattccacgttaactaataagaaaatgactaaaaaatatacagaaaaggaaaagaagaaggaatcaaaatagcatactaggggaaaaaactaaacacaaaagaaagcaataatgtattagctgaggaataaaaaggaaatatatgacatagaaaacaaataggaaagttttttttttttttttttgagacagagtctcaaaaacacccaggagtgcattgcactacactccagtgtagtggtgcaatctcagctcactataacctgtgcctcccgggttcaagtgattctctgcctcagcctctgatgtagctgggactataggagtgcaccaccatgcctggctatttttttttttttttttgtagagatgaggttttgccatgttgaccaggctgatctcgaactcctggcctcaagtgatccacctgccttggcctcccaaagtgttgggattacaggggtgagccaccacacccggcctacagtgacaaattagataacttagatgaaatagagacattcctagaaaacacaggctgacaaaatctattttaaaagaaataaagaatcaaaatagggccatagtggctcacacctgtaaccctagcactttggaaggccaagggagggtggcttaagaccaggagtttgaaaccagtctgggcaacatagcaagaccccagctctacagaaaattaaaagaaaattagccaggtgtggtgacacatgaccgtggtcctagctactcaggaggctgaggcaggaggatcccttgggtctgagagttcaaaaatacagtgagctaagatcatggcactgcattccagcctgggcaacagagcaagaccttatctctattaaaaaaataaaataaaatgaagaaaaaaaacccatatgatcatttcagttgtcatacaaaaagcatttgacaaacacaacaccccttcatgattgaaaacacctggccaacaaggactagagaggaacttcctcaatatgataaaggacattaatgaaaatcccacagctaacattatattcagcggtgaaagactaaaagcttccccctatgaccaggaacagacaaggtgcccacttctaccactgctattcaacactttactggaagctctagtctgagtaattaggcaagaatgataaataaaaggcatataaattggaaaagaagaagtaaaactatctctatttgcaggtgacatgatcctatcatagaaaaccctaaaggagctacaaaagaatatattagaggtaatagacaaattcaacaaaattgcaggttacaagatcagaaataaaagttctacttctatatactagcaataaacaatatgaaaagaaaattaagggaacaattccatttaaaataatgtcaaaggccaggcgcggtggctcacgcctgtaatcccagcactttgggaggcggaggtgggcagatcacgaggtcaggaaatcgagaccatcctggctaactcagtgaaaccccgtttctactaaaaaaaaaaaaaaaaaaaaaaaaaaaaaattagccgggtgtgctggcgggtgcctgtagtcccagctactcgggaggctgaggcaggagaatggcatgaaccctggaggcggagcttgccgtgagccgagatcgagccactgtactccagcctgggcgacagagcgagactccatctcaaaaaaaaaaaaaaaaatgaaaaaaaaagtcaaaaagaaatacctaggaacaaatttaaccaaggaggtgtaaggcttatgcaccaaaaacttaaaaacgttgctgaaattaaagaaggcttaaataaatggggacacatcctgtgttcatggactggaaaagataacattgttaagatgataatactacccaaagtaatttaaagattcaatgcaatctccatcaaaatccctatgtcctttttggcaaagacgtaaaaacccattataaaattcatatgaaatctcatgagatcccaaatagtcaaaacaattttgaaaaagaacgaagttgaaagactcacatttcctgatttcaaaacttactacagagctaccataatcatacagtgtggtaccaacataaaaacaaacttatacagatcaatggaatacaacaaaaaccccacaaataaaccctcatgtatatggtttaatgattgatacaaggtgccaacaactttcaatgcagggaaaggacagtcctttcaacacatagtgttaggaaaactggatatccacatacaaaaatgttaaattggacccttactatacactatataaaaattaattcacaatgggtcaaagacctaaacatactagctgaaactataaaattcaaagaaaacataggtaagacatttcatgacattggatttggcaatgatttcttaaatacgaagccaaagatacaagcaacaaaagaagaaataaaccagatctcatcaaaattaaaaattttgtgcttgaaagcactaataacagagtgcagagaatagaaaatatctgcaaaccatgtatctgataagagattaatatccaaaatttttaaagaactcctataactcaacaacaacaaaaaaaccaaaccaccaaattttaaaatgggcaaagaacttgaatagaaatctctcaagagaagatatacgaatggccaataagcaacatgacaagatgtttaccattcctggtcattagagaaatgctaatcaaagccacaatgagataccacttcacatccattaggatgactactatttaaacacaaaaaacaaacaaacaaaacagaaaagaacaaatgctggagatgtggagaaaccagacccatgtgcactgccgttgggaatgtgaaacggtgcaaacattgtggatactattatggcgtttcctcaaaaaaattaaacatatggctgagcgtggtggctcacgtctgcaatcccagcactttggtgcactgctgctgggaatgtgaaatggtgcaaatgttgtgaatgttatggcatttcctcaaaacattaaacatatggctgagcatggtggctcatgcctacaatccctgcactttgggaggctgaggcaggaggatctcttgagccctggagtttgagactagcctggtcaacacagcaagactctgtctctacaaaactaactaattatcatatgacttagccattccacttctaggtatatactcaaattaatagaaaacagggatattacagaatatccatatatataacattaatatggatataaaatatccgtaatataatatggaaagcagatatttgtattctactgtttgttattcacaatagctaaaagagatagcaatcttaagtgtctattaacggataaatggataaacaaaatatagtatatccatacaatggaatattatgatacatgctatgacatgaatgaaccttgaagacattgtgctaggtgaaataaaccagccacaaaaagacaaatattatagtaatctacttaaacgaaacaccctgagtagtagtctaattcatagagacagaaagaatagtgattactggacagggaaatggagagttactatttaagagtttagtttaggatgacgaaaaagttctggacacagtagaggtaatagttttaagacaatgtgaatgtacttaatgccactgaattgtacagttaaaaatgcccaacatggggaattttatcttatgcatactttatcacaatacaaagagataacttattttttaaaaatccattataatgttcagaacgtctaaactcctaagtaaaagagccctgaaacttgctaggccttcagttctttattcacaaagcccacattgataatctctcccgtgagaatgtaaaattcaaacagaaaggttactagtcttgattaactcacagaacctagaataatatatatgtgtgtacacaatgagttttgagccggcagaagtattaccactgttagcatcttgtgtgttgcccacaaactataggttgattaagtaacaccaatatcttatttcaaatgagataataatatatggcaaagtgttttgcaagttaccacatatttaatgtagtattattaatttttctaaagaaacagttattgttctgttgcccaggctggaatgcagtagcattatcatagctaaccgcacccttgaactcctgggctcaggtgattctcttacctcagcctcccaagtagttgaaacataggtgcatgccatcacacctggctaattttttatttttatttttatagagatagggtctcgcaacattacccaggttggtttcctggcctcaagaggtcctcccaccttggcctcccaaagtgctgagatgacaagcatgagccactgtataatactgtagaacactgtacaatagagccacctggccctattcattattaatattaatatgttaaatatgtggtaactagcaaaatcctttgccatttatttcatttgaaattattaatactatgttaaatactaaatataacagtattattaataatgtatgctaaatatgtaataaatgttattttttttcccccaaatttaactgccaacaattgtcaattccttccatttttgatctatataacactgaacaggtaacgatctttaaatcgtacatggtacttcaaagatcaaaggctttggagttaagagacttagatctgaattttgacattgttgtttgcttgcagttatgacctgtagtaagttatttaggtcttttcatttcttttgtccttctcctatctttgatcttactcatgttactccttcaattttatctcaaatgagtggaaaaatagtgttaaaatcttcatactttgtgaacaagatcaggaagctcatggaaattctgccaaaaatcaagctattttgtatcctgctcccacattaccaaggaacacaaggtgaagattaattgccattgcaatgtggagacatgttaagtggtaaaaataccaaaaaaaactattatttgtattagaaagcaattttgccacggaaaatggaaacccaaaaaaattaaaaggaattataactgttacataagttttaaaaatttagcaggtcaaagaggtcagttcagaataaaagaattcttggtattttaggggtgggaagtaaagaaggggtaggaagaggggaagggaagcaaagaacaataagttctacagatttcaatttttctttgttttttccaataaccacaaaacaggacctcttagaattaggaaaaactaccaaaattcttttaagtatgctaaatctaaccacgctagaataaaaccatagataatgcagatcttaagtagttttatgaaggaggtacagcaatataataaaatgccactgatctggactccctaattccataagactatgagctccagaagggagaaagaaaacttttggtggtttgatcactgctgttttcccagtgtctgaaattgaacagtgatcaatatacaacaggtgttcagtaaatagttgttgactaaattacctcctctttcaagtgatcggtttttcaatacataaaaggaaaaatatccttgttacttttgcggttgatttattgtgtggttattctataattatttatgcattgcttaactttgaaaaagaatttaaagcaatacaaaatattattttgtattttcttcagtccccttcaaagttttattcagatttataataatatttgtacgtcttcagccttcttaaactttactaagagaataacctgaataaaaacacaaaaagtgttttgatgtaaccatttctcactccctgatcatctctttgtcatgcaacaatttcacttgcagcatgaagataataattatgtcacatttaattctgaagaggaggaagttccttatttcctagtatataattgctaataaaattctcccaaagtcaagctgctcttacagcttctcagacagctggtcattcaatgatgttctttgttgtataatttcttaatttccagaggatttattttccctttctcctccttagacaattttatagctcagcacaatgtaagtactgtgctatagtacttgaaggcaatacaattgttcttttaaaatatttgataactagaatgcttcactaatattagcaaacctacatgatttatttcatcagaattaacaagatttccatctctctgcaaagtactatccttcactgtctcaactagataggcagtccttaagacaaataactactgtgtaactttctaaaataaggtagctgagttcatttccattgttactattcactgctattgctaaggcagcaagttagggactgagatacattatcctttctctgatagatgaacagggaaaaaaatcctaagatgtcagcaggggaaagatgaattctttacctcccaaatccacgaagatgatgagaacctttggtgtcatgataattttgattcagctatgttgtagagttttctgtgaatcatcttgtaattttaactttttttaaaaagtaagaaagtgttctaaactgactgaaaattagtttcttatacaatacatttttgtttctgaattgccagctgcaaaagcctgatggaatcaagtatatcacaatatcctataaactcataaataaaattaaattgaattctggaattaataatagaaccttcttatattttgggttttaataaaaacaagagaataacttgtcttctcacaaaaacatatattttaatctcattacttactacttattgaccacctccataataagataactaacgcctaaaatgaacaattcaacaaagatcaaatgtaaaattatgactggtgagcctaaatccattacatttatatttcatctgggtatcctgcgtgggacataagaggagtaacaatataatctgcccaatattatcaaattaataggttaggacaattcccatatagtatttgtggcttctgattttcatcagatacacacaaatatttagcaatgtagtttcaacaaactaccacaactactttcaaatattcactaaaatatgaaagaaaaaaaaaaacttactgtctcggagcgtttcccaagcccactggtcatttttgaagaagagatgtcgtttgatttcttctacaccatttcgccctaacctcacttccctgaataatgacagaaggagaaaagtaatcaatcatttaagatcttattataacctgtccaggtttatttgtgggcaggatattaaatcagtgtaggacgacaaatatagttctaaggtgaaattatattgtcagcatagtatcagcccaaatagaaaatatgttaaagattgagaacattaaagaatttttttaaaagaaaactaaagaaaggctggacatggtggctcatgcctataatcccagcactttgggaggctcaggtggggtggatcacctgaggtcaggagttcgagaccagcccagccaacactgtgaaaccccatctctactaaaaatataaaactagcgggtgtactggaacacgcctgtagtcccagctacttgggaggctgagacaggagaatcgcttgaacccgggaggcagaggctacagtgagctgagattgcgccaccgcactccagcctggatgaaacacagcgagactccgtctcaaaaaaaagaaaactaaagaataactacaaaaaacacccatgacttttctactgacaacaaaaatccagattaatcaccaccttacttcattagcaaaatgaataaagcaccatgcattttcttgacagttttttgtgtgtgtgtgttatttttttcttacaatggtaaagttaggcttttttttccccaaccaaaactttacttaggcagcaataccagatgctaccaaaaacctccagaaacacatttaaaattttgaacttccaatttataatctattaattatttctgaccattcaaaagccaatgactactaattcttgatactgccacagaattcagagctttcactggacaagttactgataccagcctcttttttggtgagcaaaaagtttttaaaaatgtgattttagctgaattggaaaaagaaagttagcaccttttttccctagtacagtgcttataaataaagaaaatactctaaattctaagtttttgcataagctaaaagataagttggcttagacatgtgacaatttttccaagaagctttcactaactctcaaactggattagaaaacctctccatggttctccggcacatggtacttatctcatggtaattagctgtgtgtactataaatgtctgatttgcttatctaattcccccaaaggactatgaggtatttgagaaaagtggctctgtatcttcctcactactatatccctagcacctaataaacagcataatacaatgctttatattaaaatgtaaaaattggccaggtgcggtggctcacacctgtaatcccagcactttgggaggccaacgcaggcagatcatgaggtcaggagttcaagaccagcctggccaacatagtgaaaccctctctatcaaaaatacaaaaattagccaggcatggtgacaggaacctgtagtcacagctacttgggaggctgaggcaggagaatcacttgaatccgggaggtggaggttgcagtgagccgagatcatgccactgcactccagcctgggcaacagagtgagactctgtctcaatcaatcaatcaatcaatgtaaaaattagccaggcatgggtggctcaggcctgtaatcccagcactttgggaagctgaagtgggaggatcacttgatcccaggagtttgaaaccagcctgggcaacagagcaaaaccctgtctctatttaaaaaaaaaaaaaaaaaaaaaaagtaaacatttgaaaaaccatacttcaagctctaaaggacataatgaagggagacaagttaaagcaaatctcaacttgaaacatatttaaaagtactaggtctccctaatatttaacaatatacaatcataaacattaaatataatcttactaatacatctggttcactttcaaatttcaaaagtaaaccacaaaggtatatataatatgccatttttctttcaaaaatgcagacagacattattattaaaatgcttgttggatctacaagatggaacaccaactattatgtctagaagaaaaaagatagtatacttttaaaaatggctttatactattgactctttcaacaaccatataccatacatcatcaaatctaaaatggtttaaagtataaggtgtatcaccgtttttataccactatgaaaaaggatgctcccaactcataccattgactgtgagatgtactctaatttcagagatgttatgttaaaaaatttttttagattcagtaaaatacacagtaatttttataattaaccaagttaaaaattgaacaataaaagaaaaaagtcatctagtttagccatcagccaagactgtattattatcacaatttcttaggtatgataagtgagttgagatctacaaaagacatctagaatatcataaaattacatcaggtttcactgtcatttatattctaacaatttacatgtagaagctcagatatggaccttaaaaatggagcagaagatgagaagtcctcagaattaatacaggctcagttttaaaattatttacctgtcagtaaggaaggcacaaataaggttttttgcttcttttgatatgtcattatcatcaggaaaggtaagtgaatttttatggttcataattttactgtaagttccaaccaaagaatctgcataaaaaggtgtatcacctgaaaaattgataaagaaaacaaaagcaaaatgaaatacatttttaaaaagtcagtttcaaaggaagagtcaaagttacccgtttaaaaagattattaggtatgtattaaactaaaaacatacacctaatatataaaagaacacatcacaaagttgctctaagcctctaaatgcttttaaaaacacatacgaagcaggtttggatcatgtttattacccacaaataaaatcaagattgcttaatataataaatatattagaaagagccaagtggcaagttttgagatgaacaactgtaatagagagacataaaatcttccttactcacctacaagcatttcgtataaaaataccccaaccgaccaccagtcacattctcttccataataaccatcaccaccttgggattttaatacttcaggggaaatataatcaggtgttccaaccgctgtatcacatcgtaccatgccttcctaaaaagcgcggcaggtcaaattttgaattaggatataaagtctcaattatttaaaatgactttcttattaatattacctatgggactccaaatctttgagctataaaatatcatatattaaaactgaatggaaacctgacaaaaattaacacagcttaatcatatatatacatactatatacacaccatatacatatataccatataatgtatgtatgtgtatacatgtgaatgcatatacacacacattatatgtgtattcacatatatacacacaccagtgattattttgtaataatgctcactagaaaaacatactgccacatttattattccccaagttgtgccaatatcatgaaaccatttaactgctgagaacaagtacacaggccagtgcaaatacactggggagttcataggatagggcattttacaacatattggtataaacactgacttcattattttctactaaaatagctatttaactatgtttgaaactacaaaagaaacatacaaaagctgactgtacaaatacaaactggggaagcatatgtatgggaaaagggcataatagtgtaaagcacactgaatgtctatttgatgtgaattttaactgccctcccccaacaaacctgagagacttgttagctgttacctatattcgctggtattaatgaaacagcattataactaaatgttcatacagaagttctcatgcagtgtttccttcactgtgtatatgaagtgaaggaataacatatacacagctccttcagctccttcagctgtgtatatgttatttattatataaataacatatttatttatgttatttattatatgtatatacatatacataatgtatatgtatatacatatacataatatgtatatacatatacagctgtgtatatgttatttattatataaacagtgaggataggtatcttttaagactcactcctaaaataagcagtaaaatcttttatatgttaactgaagtaaaacactaaaaaatacacacattactggaatccaatttttatgaaagtctaattttaacactggcataagtatttagtgacatttaagctaattccattcctagttaccagtagtgtatattagagttgttatgaaggatttagtaaatctggcaatccatatttaccctaaatagagaggaaaaaataaatcactaacaagttactaatacaacattgaaaccatggtatctagttcaacaaataaggtcatattaattctggacaagtccagctatggttagtaaattcttacaccattttctaaagaattcttaaaccattttctaaagaagcatctaccttgaattagcaaaaactaaattaaaatctagttaattaaccttattcatcttcatacaagtaccaaaatctgctaacttcaaatgtccagatttatccagcagcatgttatcaggcttcacatctctgcaggagggaaaaaatagtacagtattttctgaaacagattagacactgtaaaaattatatgaggcagttattttaggtcaagcatcctcaatctaggtaaggccatctttgatctgtatgtgttctctatccacatctataaattaaatttcatcaaagaaacttctttatatgttaatgcctcagaagaaaacatatatattccttttttaaaagtttcattctttcagagggaaaatcaaatcatttgagagagacagaccatcaaaaatacaacactcagacataaaaggtgattgaaacatattagataggtaagtacataaaaaaaccccacggcagggtctaagtcactttcatttttgatccctgacatgtaggcacagcaactgcacacaggattcaagcagtgtttgtacaacaaatgaaactattcgtctaatgaataaatacgacctattcactaattaaaagcaaattaagttacatatttaaaaaattaacatcaaagtgtttaactcctggcacataccttagaaaactagtttacaagttttacttttcagaacaccatttaaaggctatatgatcagattaagggatattaaagaatacatttatatcaacattaaattgaaatgctaaaattataaacttcaaagtttggagttctttttttccccccttcctgacatagaatctcactctgtcacccagtctgaagtgcagtgactagatctcagctcactgaaacctctgctcccaggctcaagcgatcctcccaccttagcctcccaaggagctgggaccacaggtgcatgccaccacacctgtgttttttttttttttttttgtagagatgggtttcaccatgttgtccaggctggtgtcaaactcctgagctcaagagatctgcctgcctcggcctcccaaagctctgggattacaggcgtgaggcagcgcctggccagagtcttgagttctgaaaggtcacttatgtcatacggaagaagaatgggtgaactgagagtaagaaatgttaaagttatttttagctatttccctcaacaaatgagaaaatttaaagcacttttatctttacctgtgaataaaacccatggaatggattgcatccaatgcaagaactacttctgcagtatagaatcgtgcccatttttcaggcacatcatagttgctcattaagtttacaagatctccaccaggcatgtattccatcaccatgtagagataacgatcatcttggaatgcataaaaaagctatacaaatagaaaaaacaaacaaaacacattcattaatgttaaacaaaattgtttcacttaaaaagtggcaaaaatgttaataaaagatttaagtaaaataatcaaattacagaagttgcaagtctagttttaaaaaaagacaaacataaatgccacaaagacccttgtatatgcaaaatgactataacataattattcagaagagttacatggagatatcctttcttcataattttctacactatttgaatttcttttactgagaatttttttaaactgtaatattttcagtaaatatacaaatctcctaggcaaagaaatactgtatttctaatttaacttgtgcatcagtggggtctactattaaatttatatcaatatcacaatgctcaagaagtctttgataaatttggcttacagtttcagctgtttttttttttttttttttttttttttttgagacggagtctcgctctgtcgcccaggctggagtgcagtggcgtgatgtcggctcactgcaagctccgcctcccaggttcacgccattctcctacctcagcctcccgaggagctgggactacaggcacccgctaccacgcccggctaattttttgcatttttagtagagatggggtttcaccgtgttagccaggatggtctcgatctcctgacctcgtgatccgcccaccctggcctcccaaaatgctgggattacaggcatgagccactgcgcccggcctcagctgtttcttattagctgtgtgactagtaatttgcttaacctacccgagtctatgagactataatctcttctaaaacactgtaaggactatacttcgtttaacttttatacctgctgcttagtcaagtatccagatgcctggcggttagcaattgcttaataaaggcttaatgaaccaaatcataaactaatccataaagtaacagtgcacctaacagattaactgtctttcagggttgagggttgttaaaaaagattactgaatatagaaagcacttagtgcaacagatgctcaacaaatgacagcagtcaggaggaggagcagtaatagctaacacagaagtaggaggaaggcagcagctagggttcaaatagtaacagcaaaatccactaatgtgaaattagcgaggatatcaggcataaatatattatgtgactggggatcaaataaaaagaagggcaaatttataaaataacattttaagtaaatacaagaagtttagaattaaactaaaaaaaacaagccctagagaagatgatctctaatttacccagatgtttgtcttaaaatcttcttaatgtttcatttttttcaactgtgtttaataattttagttatagattcagttactttgttttgattttttgtttttttgtagagattgggagccagtcttgaactcctgccctcaagtgatcttcctgtctcagcctctcaaagtgctcagattacaagcatgggggccaccacacccggcccagactcagttattttaatgtaaaaaatgtattttgggggaagagagaaggataagaaacaaagtggcatttcatgactatcccagattaaagtatataatttgtcatttgggccccataaagaaatactgttaatttggtgacagtttcaccctatttatagacaatatatccagagaaataaagctctgaatacctaaattgtaaatagccctgaaagtaacaattatgtcacatattttttcactaacagacactgaacgttcatgtatcagtggttgttaactagtggtgaaaacatttttggttgtcacaactgtgtgtgaggtgggaagagtcactactagcatcccctgtgtagaggccaggaatgctgccaaacatcctaaataaacacattagtaactgaaataatataaaggatagcccccaacaacaaagaattatctggcccaaaatgtcaatagtattaagcctgagaaactctgatctacatagttggtaaaaacatagacatttcaagtttaaaagtactatggtgaccgggcacggtggctcacacctgtaatcccagcactttgggaggccgaggcaggcggatcacgaggtcaggagatcgagaccatgctggctaacacagtgaaacccgtctctactaaaaatacaaaaaataatagccgggcgtggtggcaggcacctgtcgtcccagctactcgggaggctgaggcaggagaatggcgtgaactcagggggcagagcttgcttgcagtgagccgagatcgcaccattgcactccggcctgggcgacagagcgagactccgtctcaaaaaaaaaaaaaaagtgctatggcataaaccttcaacatttttcatatccttttaattccaattactggtatgctttttaaggacagacttcattatatattataaataaatcacaaaaacatgttagaaaattagaaatggtctagcccagtttaacttcccccgtatgacattttgcattaaggatcccaatacataagacagataaaacatgaagctgaactcataaaagcagagagaaaactcagaattataatctacccaaaaccccacttgaccccatgattttgcctaaggtacctccacaattgaacataaccaatcaaagacaactttcagacttatgaacaaggaaattgtggcccagagatgttaagtaacatggccacagcttcagagaaaggcctatggcaatcaagacgaggacctaaaactactgacttctagtttttctttccactgaaaaccgaaagacaagtattatttggtgacctagcttaacttggtttcctctcactttcccttcatttctcttattatctcctcttcacaaaataagagacagataaatgaggagacagctaaacaaaatgagagcctcatgtttggggaaaaaaattcaatattaactaaaagtatctatttaaattttaataatatacgacttccctcaaatctaagtagattaagttttctatatcttctgtatttaaaaatatctaatttaaaattctgtatttaaattttatatttattatttttatttttgagacagggtctcactctgttgcccaggctggagtgcagtgatgtgaacacggctcactatagcctcgacctcctggactcaagtaatcctcctgcttcagcctccccagtagctggaaccacaggcgtgtaccaccatgcctcaataatttttttaattttttgtagagataggtgtcactatgttgtccaggctggtctcaaacccctgggctcaagctatcctcccgccttgtcctcccaaagtattcagataacaggcatgagccatcacgcccagcacaaattctacatttaaattaaatttcctatatataaattctacagaagcatggttattttgttctagcctttcttgctagaaatgattcaatacaattaaattttaagatttaaaaggtaattagacaattttgtaactgccagtaaattctctactactattctaaaacacaaactaagcttctcagacatgtttagttacaaactaatgcagcaataatgaaagagtagcaaagtcatacctgaacaacccaaggactgttggcaaaagccatgatgtccctttcttcccagaaaaaagcagaatcagatctctttatcatttcaaatttgctgagaagcttcatagcatataccttcctggtggatttatgccttacctttaaaattgaaaagggaaaataatgaaccttttgttaacatttaaagctcaaggtttcacagaacaatttactaagtgcttttaatacttgctaaataatttagccttactgtttcagttatttttatttcttctcttctgccaaattattccaagtagctaatgtcaagactttaattatcagaagtaatgttttaaaaaaatttttatttcctatattacaagacactttcccccctccacacggctatgtaagctgcttcctgtttataaagcttactgttctacagcattttagtctaatattaggagcaaagatttatcttctgatgcctgacacttcttttctgccacagatacttggggaaaacacttcccactatggctagatttgacactaggcttccataccctcaggcaacaatgtctaaaggaacttaaagcaacaattctataaaaacagtattttcccaaataatatgttaaacacacaagtggattattttaatttaataaagtccttttgtattctcattaaaataacctaccaattgaacttctccaaatgcacctctaccaatcaccttcactacttcataatcttcagctttcattcgtaaatctctgattttatttattgtgtctttatctgtatgaaaagaaaagtttatcattttaaatcactaaagcattacaactagcactacttattttacattcgagttcttaagaaacacaatgaaaaacaacaaacttcatgaagaattatttgaaaatatggtgaaacttgaagctataaagtagctaaatgttcaatttgctaagattttttaaagtaaattccagaataacttcattacaactactaaaggtttttattaatcaaaatttgacttaacagaatgttttaaaaacaaatattacactacaaacaaaagctgaaaataattagctaattagttcctggtattttaagtacacatcaaatctgaatttaggaaacatgagtagatattttagattaatactggaataaatttttctttttataaggtcagttttagtgatcctttaaaaaaagatgtaatttaagatatcaaaggcaaacacactaaaaaaaaaaaaaacagtaaattttccaactggtaatctttaatacttatagcattacatttctctatttgaacctagattttaacttgaaacacacagtgaaaatcactgcaattatttatataaacttgtcatactacaaactacaataattcacaaatccccactggatagatattctaattcctaatttggtcatagattaaaatagggctattttaatccacatgggtcaacactggcatgagattacatggaaaagcttcacatttcagagttgtacaaaatacacagcagctattaaacttcagttccagttcctaataagagctgtattaatattcttgttttccttttcaaatgcatttaaactcaagtgtttgtgtactttatgaccaataaatacatgtaacagagagcaaatttctacaaagttataagtacctttaattttaggttacatatccactgcaagatgcaccagaaagatgaacaataatcaattaattcgctgcacaaatatttctatctaccatacatcaggctgtacagcactggagataaataaacataactttaaaatgtagttcctattctttaagagttcaaactctagcaaataaaacagaaacaatgaaaaaaagaattcaaaaaatgtaataaggaagataaacagttttttgagtactaaggaggacacctaactaaagcctgctgggtgagagatagctaggaagactttctgtaaatgatggtacctgaaaaaagtctaaactgaatagtagcggttagctagatgatagagaatgaaagaaagaacaggccaggtgtggtggctcatgcctgtaatcccaaaactttgggaagctgaggcaagcggaatgtatgagtccaggagttcaagaccagcctgggaaacatgatgaaaccctgtctctacaaaaaatatttttttaaaaattagctgggtgcagtggcagtttcctgtagtcccagctactcaggaggctgaggtgggaggatcacctaagcccaggacgtgaaggttgcagtgagccaagatcacaccagtgcactccagtctgggcgacagagcgaaactctgtctcaaaaaaaggaaagaacaagtgaacaatataagcagacaagcaatgtaaaccaagcacagaggaactgtatctaagttctatgttgctggagtatcaagtttgtagtaaggactgacagaagaggctggagagccccaggtaagttcaggagcttgaactttacctatcagccagtagttacagtaataaaactaatatttaagtaccgaaaaccgttttcacattaaagtttaaagtagctctctacatgaaatagatcaaagaaactgctctgttctaaatgaggttaaaggtgtcagagaagagacagagcctcatctacttcaggctcttccataatacagtccctgaggaatgctctggaatctgctgggaactgagaagcaccactactatgggcaggaagccatgaaaaggaattatgatggataaaacaacatagtcaaacttacatttcaggaaaactactctaggaaatacgtagaagatgagttcaataaagtcaagacaggaggtggggagaattttaagagtattgtaataccccagatgagagagaaagttctgaacctggataatataatagcctgttacgttgaaaaaaagattcttggctctagctatgagctagaataggctgtagagtcttgacaaagaccgcagacaagtcatttgaaatctaaaagatctttctatgttctactgccttggattctagcttgttctaatacaggtttacgtgctaacaagtgtaaatgcctctgttggatggctttcaatcaaactcagagattctatggttctacttttcctagttcatctcaccaagggtccaacctagaactaataaagaacttaatggtaaaattctaagcattggactttagtttcccaaacactcaggactatgtattcacacctacccaaatctcaggatcttaaacgaagcctatttattgtaaagtagtcatgtaagaaacccactcttggtctaggggtactatatagcctgaactttgtaggcttatggctccattgagacagaaaacaatgcatgcactagaacagggattcccaacccctgagccgtggacctgtaccggttcatggcctattaggaactgggccacacagcatgaggtgagcagtgggtaggcaagcattaccatctgagctccacctcctgtcagatcagcagcggcattagattctcacaggggcacaaaccctattgtgaactgcacatgcgagggatccaggttgcacattccttatgagaatctttttttaatgcctgatgatctgaggtggaatagtttcataaaaccatcccgtctgccaccccccaacccccatcctgtccatagaaacactgtcttccacaaaactggtccctggtgccaaaaagtttggggactgctgctctaaagaaaaataataagtacataaataaatatgtaacttaatttcacattgtgatacatattctaaagaaaataagaccaagctttcccaagtctgtaaggggagactatatacacaggctaattcttcagtcacttcaaactctgcactgattcctcaaataaacaagagtcaaggaaaacaactcaaaattggttattttttaattgactattgatgccactcccaatacccccaattctttgagcagctattcttgcccaaaggctaacagtcttaggcaagtttttctctctgtacacatttgtttggctgctgcaatcacacaccatcagtgaacagctttctctgctaggctagtgaataaaccactcatacacttacataacattgcagcctcttttttttttttggtcaagcctgcatgaacatttttctttatgaagaaattttactgggatgagatactctgttttaaattttctattttttctcactgttgctgtcctatgagtcaggaagatcatagtgagtgcttagtctgggaatgtccaaagtacactgtattcctttagcacagctatactgtcattgcataatttaaaaaaatgctttgccacctaacttgataaaaataatccattctccattatgcttcaaaaaggacaacatttgggctgggcatgatggctcacacctgtaatcccagtgctttgggacacagaggcaggaggattgctcaaggccaggagtttgaaaccagcctggacaacataccaagacttgtctttacaaaaaatttaaaaattagccaggcccatggtggcatgcacttgtagtcccagctacttgggaggctgaggcagaaggactgcttgagcctaggagttcaaggctgcagtgagctatgaatgtgccactgcactcctgcctgtgtgacagtcttttaggggagggaaaaaaaaagacaacatttcaagtatactcttctcttcttgctttgacacatgcgtatgtactggtaatagaaaacaaataaaatgttgtgatatggtgatacatatagcactcaaaactgtcaagctgtaacagcatcactgtgatttctactgtgctgagcagcagtgtgaagcaaggagagcatcacatatggtcgctgttgtagctactcagcttaggtgttgtagaacaaaagcagctatacacaatacattttttaaagtgtagcaacgtcccaagaaaactttatttatggacactgaaatctgaatttcctattatttcacattcatgatattgtttcattatttcaccatcatgatcatgatgggctttaaaaaccatctacatatcaacttccaaatttttatctctagtctagtctctcttaaacttcaaacttatatatgcaattgtatattctttaattatatattcttttgacttttttttcaatcatgaaaaaatacaaaaaacatgcttagttcatgagccacagtggtgggtgagatttggcctgtgggctgtagttcaccaactcctgctctaataaaacccagtggccttctgagggcactgcttccccacagctctcaagtggggacctttacttttccacatgccttagacaaccgaccctgaaagtgggagatcccccacatccccacccctaaatctgctagctttgattttcattatattaggttgtatttcccacctctcattgttgctgtaatctactgactctcagaggtcaccacgtctcatcgctagacagttttacttcctgatttactgaacttctctccaatattctcctgttttaattcttaataactttaatatacccacagataatacttacagtaccttggcctctcaacacctatacttctctccttcaatgatcttgtcctctaccttaccttggtcactcatttccatggtcatatactagaccttgtcattactcataattataatcttccaacaatttcaattagaaaacttacactctctaagcactctcttatagctttcctgcttagttcctctagcatcttaactccaacaaccccaaccccaccaggacctccaatccattgattctactacactcatactttccctcgttgcactgatagcctctttttcctacctagccagcttaaattacatggtcaattattataatcactcccttgcatatacctttaatgtcatgagctctcttctgcctcactttacttagtttggcaaaacgacaatcctattatagttaaatccaactctccaactactctatgtcagcacccatgcagttgaatatgtctcaataaatacataaaatcacaatgactgatcctattttaaaattcataatcacaaacatcaagctggcccttagttctacttggcaatcctaaatttctagtcactctcccactctcctagagacgtatttcaagttttcttctttcttcacacacacctcccacagctctcccactgatcctcgttcacagctaatgatcttgtttggctactaccctgaaacgaacgaaacaatcagaagaaaactaccactgacttaccaccacttacacacttaactatcagcatgtacaagcatatattttgtcttttcatattttactatgggagactacttctatcttaacttaaaccctccactcatgcactagatgtcatcctttttcattactgtagttcaaggacattgctcaagcaattctcccctttctcctctattactaagctttacccctcctaaccggatcccaccatgctgttttctctcccatcttagggaaacaaaaaaaaactcttgatctcatttctctcagcagctactgtcccattactcaactccccactgcagcaaaatttctcaaaagttgtctataatttctgtgactaaatctttcctactatttgctctaaaatccacttcaggtcggctcttacctttctttcaaaactacttgtcaaagtcacaaatgagcatcatgttgctaaatccaatgaccaattctcagccctcatcttgatatatcagtggctttaacacttcaatcactctctcctgatacactttctttacttgactttcaggacacaacattcttccaacaatactgaagattttacttttcaaccttagtagttttcagttgccttggctggttcctccccttctctcagatttcttaacactggagcattccaaggctcagccctcaatggtgacttcttctctatctacactcacttctctggtgggctttaaaaaccatctacatatcaacttccaaatttttatctctagtctacatgtctctcttaaacttcaaacttatctattcaattactttcaaaatatatcctcttttgaaaaacatctcaaatttaatgtgccaaaaactgaagaaatattctcacccaaaacttatacctatgtgtcccacactttggccgatggctcaattttgctcaggacaaaaacctagggggcattcttgactcctttttttcttacactccacatcctatctttcaggaaaatatgttggctctctctttgaaatatatctgtaatctgatagcttctcaccctctacattgctaccatgctagaccaagtcaccatcatctcttccttggattactgtgatagactcttaactgattgccctgtgtctattctcaacatagggtgatgttcttaaaacacaagtcagatcatgtcacttctctgctcaaaagtctctaatgtcttgccatctcacccagagcaaaagcccaagattttacaatggcctacaagactctacatgacctagcctccccatttccttacctctatgatatcatcctacaattctcccccttgcctaatcctctccagccacactggcttccttgatgttcttcaaacaggccaggtacactctcctcccttcaggcctttgcactagctgctcctctgtatgccactctcttccctcagacatccacatggctaactccctcaactacttcaactcttttttcaaatgtcaccttttaacaaggcctaccctggccaccttacctaaaacagcaaacttctcagaacttccgatccttcttaaactgttgtatcttttcctatggcagattttgacctctttgttattcacaaaattagttttatgcaaaataatatttgcaaaatcacaaatctggtaagtcttccttcattctaaaacctccaaataggatgttgtgaccatctagactcttttagcaatttctgattgtcaactatattgagtcaggtgatgctggcagaaagctaagattcagagaagtgaaatactactatgcaacatattcagcaagaaataaaatgagcaaattgagtcataaataggaaccacagtcttgacaaccactaactagctaatcattagagctagtcgtttagagttaatctttctccaaatgatcacaagttagcaaaagggccagtgcaaaaaggctaacttacagcttctgggttaccaaaaattcaaaagcatttcaatcatatataaactcttcaatctaattttcaagaaagcaaatggatgatttttcctaatactgttttaaaaattggccaggcgctgtgactcacgcctataatcccagcacttcaggaggccaaggcaggcggattgcttgaggtcaggagttcaagaccagcctggccaacatggcaaaaccccgtctctactaaaaacacaaaaattagccggcacggtggtgggcgcctgtaatcccagctaatcaggaggctgaggcataagaatcacttgaactcaagaggtggaggttgcagtaagccgagtttgggccactgcactccagcctgggtgactgaccgagactctgtatcaagaaaaaaattaaattaaattaaaaataaataaaaatcaactttatacccagtaaattttacttctaggaatttatcctaaggaaatgagatacaatgtgggaccaagatatctacaataaagtagtttttacaattttaaagagcaaataatttcatatacatagagtattaggtaacatttaaaattgtgttgaatatttaattacatagaattatgttcagcatataatgttgtgcaaagaaatagaacaaactgtatacagtatatgaacttgattttctaaaaacataattatatactgatacacagatatggatttttttaaaggccagaagaaaatatgccaaaacaataactgcagtcatctctgagtttggtgagactacagattattctgccacattttctatatattttaagttttttataatgaccctttgttgcttttctaatgaaaaaaacaaaagatgtattttgcctaccctaagatcctagattataaaacgtaccattactttatgtaccactagagattctaagatacattctaatttcaaaaatgttcaaagtttttttaaatgtcacaataggtaaaatatcataataaacattatgtaccttgtactgtttgaccagaatactgctactctgcctaaaaaagcccagtatacattgcatacttttagagtagtgaaagcagccctaaaaagctcaaaaattaaacttatttgaaaaattcacaagaatgttatattcaattccataaaaatctgatttttcttttctttttccttgagacagggtctcacgctgtcatgcaatctcagctcactgcaacctccacctcggagttcaagcgattctcccaccgcagcctcccaagtagccgggactataggcacacaacaccatgcacaactaatttttgtatttttgcagagacacagttttgccatgttgcccaggccgatctcgaactcctgggctcaagtgatctacctgcctcggcctccgaaagtgctgagattacagatgtgagccactgcaaccagcactgttttaattaagaaaattatttcatgtccaaatgttcaaataaaatcacactctaggaagatgtgctacattttgactgcataggcacataggcacgcatccacccacccacatacacacagagtaatccagtttgataaacagatcaacaaaaaataaatataaaaaatccagactcctaaattcaaactcctcaacatggcaaaaaaatatatatatatcattagtgactgtccagtcttatagttctagataagatactccccacaaccatgctctagcaatgcctagttatttgcaattatctatataagcccatactgcttcatctctctgtgcctttccagatgttatcactagcctaaaatgacttcccccaccaccttatctgaccaagttactattaaacaagatctaatcttttatctcctctttagacattcctgattccctctcaagcacaaggtatgactcccttctctgggacattatttccctatatttcacctaacaatctgaactggaattgtttctataggtctgtttcttctattacgttgtatgtccccacaatccttaaggatagagattatacttgtgctcgatgctactgaaatattaaaaacacttaatgacattatatacaaatggagataaacacatgctgcatttatctattcaggaacaacagaaaagccatatatatttactccaaagtaataaaagtatatatttaaaaatccatcttgagtttctcaaaatgttaaatatagaattaccatatgacccaccaattccacttctaggtatctacgcaagaacaataaaaacatatgtctacacaaaaacttctacacaaatgttcatagcagcattattcataaaagccaaaagagaatcaatacaaatgtccatcagctgataagcagataaacaaaatgtggtatatccatacaatggaatattactggcaattaaaaatgaaatactgacacatggtataacactatgaacaatgaaaacatgctaagccaaagaaggcagtcacaaaagaccattttattgatgattccttctataggaaatgtctctatagagtcggcaaatctatagagacagaaaatagattagtggttgtctagggctggaagcctggagagaaatggagactgactgttaatgggtatgaggttaccttacgaagtgatgaaaatgttgtaaaagcaactgtggtaatggttgcacaactctgaaaatacacatacacccaaaaagctcactgaattgtatacttcaaacgggtgaattttatagcatgtaaatgataacttaataaagttgctttaaaaaatcaatcttgagtttggcaatgatttttatatgacacaaaaagcacaatcaatgcagaaatataagttagatttcatcaaaattaaaatttttgctctatgaaagacattatgcaaatgaaaattgacagtagcaaatgcggcaaggatgcacaacaacagaaactctcattcattgttggtgggaatgtataataaaatggtatagccactttggaagacagtttggcagtttcttaagaagttaaacctgttcttagcaaacaacctagcaatgctacatctgtgtatttacatatctgcccaagtgaatttcaaactaaattcatggccggcacggtggctcacgcctgtaattccagcactttgggaggccgaggcagacagagcacctgaggtcgggaatttaagatcagcctgaccaacatggagaaaccctgtctctactaaaaatacaaaattagccgggcattgtggcgcatgcctgtaatcccatctactagggaggctgaggcaggagaactgcttgaacctgggaggtggaggttgccatgagctgagattgtgccattgcactccagcctgggcgagaagagcgaaactccatctcaaaaaaaaaaaaaaaaaaaaaacctaaattcatgcaaaaacttgtacacgaatatttacggcagctttattcataattgccccaaacaggaaataacgaatatgttcttcaacagaggaatgaacaaacaaaccaaggtatatccattcaatagaaggttgctctgcaatttaggggaaaaaaggaaaaagcaactacttcacacaacatggacaacatgaaggaatcttaaatgcttttatttttttttttttttcaaggcagagtcttgctctgtcacccaggctggagtgcaatggcgcaatcttggctcactgcaacctccacttcccaggtttaattgattctcctgcctcagcctcccaagtagctggaattataggcacctgccaccatacccggctaattttcgtattttttaatacagacggggttttgtcatgttggccaggctggtcttgaactcctgatctcaggtgatctgcccgcttcagcctcccaaggtgctgggcttacaggcaagagccactgtgcccagccttaaatgcatttttgctaagtgaaaaaaagacagaatcaaaaggctatacactgtatgattccatttaatgacattctggaaaaggtaaaactataggaacagaaaaagagatcagtgtttcccaggagtgggggtgatggaactgttccgaatggtattggggtgttgcagacaagactatgtgtttgttaagacccacagaactatacacactttatgcaaatttaaaaaatcaattgggattctgggggatctcaggatggaatccagattctaacaaatgaatctaaatgtatgactaacaagatgacatgccctcattgaaggtggtgagggaaaagaagctgaactacgtaatgctggaaaactgttttagctggaaactaaggctaaagacaaaaaaggaactgtacaaagatattgtgttccagttggtaaatccatttctcacagggtgtatggtttattttacatgaatattagggttgagtaagtaaataccaataatgggagccaggtttctcatcatcagagaaaaaaagttacaaacaggcaagggcaaaagctagaatgaatcttgtgatactagtttagagctggtaatatcagtctaaacacgtttaacatgtgtacaggtatagaattatagttatgtgtatagtcacaggctggtatacatgcatacatatatttcctagctatggcagctgagagggccttgaaacagtgatcaccagtagcaataagcacacctagcacccagatcttggtttctaaatatcattctccaataaaaggaaccagagctccttggaaaaaatggctgatttcagggctgagggaaaatataagatgagcctggagcatcgtgtaatgccagaaagtaaagaagtgttcctttttttaaaaaaagtaagaacatgtcaaagaacacaggagtaggagctgggtccaacctgaaggagctcccaaaaggcaaaaatgagaacaatttaagtaacaaagtattaggttggtgcaaaagcaattgagatttttgctaaaaatagtggcaaaaactgcaattacttttgcaccaacctaataaataacacactactggattacaacccaaagtatgaaataaatatatgcagtttatattatataaatcaatgactaaattaataaatgggggagaaaaggcaaatcttccctacagaattccaaataatacgtgtaaagtctcccctccaggagagtatggaaagggaatacgctcccctccacagcgtttggaaaaagaaaatggtaacttactagtggagaagcttgccagacactaccttaaaccaaatgataagcgttaacatcaccagtgatgtgcctagatttatgatggagttatgttccaatgaaaccctcataaagctggaaattttaaagtcagagaccacctggactttctagatcatctctaacaagtcagtatccaacgtctaatgcactgagctcatatataacaagtacttactatgctgtcaggtttggcagtaaaaacataaatgcccctgctctcatggcacttaaaatctagtgacaggagaaggagaaaaaggagaatggatactgtcttagtctgttttttgctgctataacagaataccacagaatgggtaatttataaaagaaaaaagggcatctggcaagggtcattcaatggtagacaagtggaagagtaagagcatacatgcacaagagctcacttttataaccccttcccacaataacagcattaatccattcatgggggtggaacccacatgacctaatcacttcttaacgtccccacctactagcactggcaattaaactttaatgagttttggtgggggcattcaaaccacagcaggtaccaattaaatagtcatacaaataaatataacctgtgataagtatacaagatgccatagaagtacatgctcagaaggtcagatccatgaagcctagataaccaagaggttagggaacaaaaatgaaggcttatttgaaatttaaaggatgactgctttgagttgggtgggttggaaagaattctagaaagagaaaaacaacatctgaaaagtcttatggaggtgtcatggtactttccaggaaataaatgtcagcgtgtagctgatgtgtaaggaaacaaggaggagaggtgtacagttaagaatgtaatttagaagcttagatagcatcaagtttagaaaatccaccaaaaagctgggaatggaatttgacttaaatttactattcaaaaagaatcctctggcagcaacgtaggtaactgtacataggcaaaagtagatgtattattgagactgaatggaagatttttgtgatcatttaaatgaaaatgaagaagcttaaacaatagttgtgttggaaaaagagggaaagtcaagcctctgtatgaagactgccactgttcagaaatctgcacttatcagtcttttctttggtttattataaccagaccatttacctatctttagttttttgggaactccatcattctccaaagtttctctaaagatcttcaatcacctcagcatgttaattcaataggtgtaaactgccttgatttagaggtatttaaaacactcaaactttctcctcttccttgaacttacttcaatttctttatctaagtttttaaaactcatgagaatttgaaaagaaaaaacaagcaactaagtaattttttttaatatccaacccattaacccaaaagccccagcctgccatttcagtctcatcccctgcagtccgtcctcccgaccctttctctctcattataaaccaagttcaatttacaccaaactcctggttcctcaaagatgtcatacttttggaagactctgtgatttaaatggtcctccctctcagaactgtccttcctccattgaaaaatctagcccatgttttaagactcaaatattactttcttttggaagcctttctttaccccattcaagatctgtgtatcattacattctctacaaacttctactattataaggtatatctgtgtgtgtttccatccatgagatggtaagagctacagtttctaagaaaaacagtcttgttcttcatgtctttagtaactggtcattcaaaaactatttcaagaatggtctcatgtagtgaaattatccttttctcacacatcttgaatcctaattctaaccaggaaggatgggagtagaagagagaatgacttgtaaagggcttaagagcttttcacaagttgtggctcattatagtcttctagcctaacacatttttaatagatttatactactcttttgtatttatccctggatatgtattcatacttctgatctggttcataaaactttataatctcagctgagaactccctgtggaagaaccttgctttctatggctgcaaccttctaatatttattgcttttgattacattttctaagcttggagcacgtgtctaactgcgcccactatttctttccttcatcaacataaagtcttaggcagttttgcctctcaagggatatttggcaatgtctagaaatatttctggtgatcacaactggggataggtgttaggatatgctactggcattaagaaggcagaggccaggggtgctgctaaacatcatacgatgcaaagaacagcctcccagcaaagagttatctgacctaaaatgtcattggtgccacttgagaaaccctggtctaaagtgaactgaatgctttgtctcaaggtctgtgtaacattctaaatgatcatcgcttttgatcactaactctgaatagtgattattcgcattactttctcagtaattgtactagtgccaaagcaaccaaaaatttaccaactgtactgtatgcttttatcactaccatagctattatgtcacttttgtaatctatattataaaagatatagtatatgacataaaatatcagttctgttttttttttaagccaaacaaatgagctctcttgcatttatacccggaggttcatgaattttcttcattcaatggtcttaccttctccattatcttcttttagactaagatttgtttgataaacatgtttttctattaacatataattatgaatcttgtaccctaaagtctctgtgacatccataatggtttataagcatatacaatcataatcactgttcccaaattttctctcccttcatcctcccaatgttctggctcccaacatgtgtcttcaaaactgtgactaactcccacaacaatcgcttaattttatcttggtatcatctctctaactcctatgaaaatgtcacctgaaatctttccttatcaggtatgtgaggctgataaacatcttctttgcagccttattatttaggtatcatacaccagagcccagaaaagtaaatctttatatttcactattcagtcaaatgttcacagattctcctttcccttttgtttccacacacttcttaacacaaagagataaaaattaacaggttgcaatataattaaacctgatgattaaaaattatatttgaggcttaatttaatatgacttaagctgaattttttaaagaaaaatattttatcccatattccaggtatattcttagatcactacatctgatatatgtcagcaaaaagcaattagaaacaaaacaaaaatttacctttaataaaataattttgatgtgcttgctgatgaaagctaaatctatataaaagaatttcagcggtatgtaaaatgctatcctatacaaatctattgctctgtgtgaaacataaaaacacaatgccagtaattgaaggagaatgttctaattatattgaaaaaataagtttgttatgtttatttacacttataacatgtttattcaccttgtttttgttcatgtctttaaattttattatgatttcatggtagccacatacattgttttccttaaaaaattaacttacatagaagtaattttttttcttgaagtaacatattggtttagaattaggctgattactaaatgagcattaaacttcatgttttttaaggttgagtttgttaatataactaataaacatagagtaaatgatgctttttgtatatagatttcaatgcatttctgactaacacatatactcatgtaatcatcaccacaaagaggttacagaattccaaggtttcttcatacccttttctaactcctgaagttttacctcaaccataggatttctagctcaaagttttgcatttccagcatgtcctacaaatggaatcatgcagtatgtagcctttttgtgtctggcttttttcacttaacagaatgcttctgagattgctggatattgcacatagcagtaattcattactttttattattcagtaatatcccactatgtggttgtaccacaatttatccattgatcagctgacgggcacttgagttgcttccagttttcagcaaacataaagttgccttaaacattttaatacagctctttgtgcagacatatgctttcatttcttttcagtaaatatctaggagcagaattcctggggtcatatagtaaagtgcatgtataactttataagaaacaaccaaactgttttccaaagtgccttaccatttaccagtcagcaatgtacagggttccagctgcaatgcattttcataaatacttgatattgtcagtttagaaagttttaatcattctaatagaggtgtactagtatcttattgtggccataatttgcaacttcctaatgactaaccaccatgaacagttctgcacatgtttactggccatttttacatcttctttggagaaatgtctattcaaatatttttcctacttttaaactgaactatttgtcttattattattgagttgttacacttgtttatatattctagataccagtcctttattggacatatgatttgctaatgttttcctattttgtaagttgtcttttcactctttttttttttttttttttttgagacaaagtcttgctctgtcgcccaggctggagtgcagtggtgcaatcttggctcactgcaacctccacctcctgggttcaagcaattctccttgcctcagcctctgaagtagctgggattacaggtgtctgccaacatgtctgctaatttttgcatttttagtagagatggggtttcgccatgttggccaggctggtctggaactcctggacagaactgatctgcccgcctcagcctcccaaagtgctgggattacaggcgtgagccaccatgcctggccttcactcttgatagtatctttgaagcataaataaaagttttttattttgatgatgtccagtttatctatttttcttttgttgcttgtgcttttggtattacgtctaagaaaccactgcttagtccgaggtcatgaagatttcaacctatgttttctcctaagagttttacatttttaacttttatattttcggttaatttttgtacatgatatgaggtaggagtccaaattcattcccttgcgtacggatatccagttgtctgaacaccactggttgaaaggactattctttcttcttttacatgctttgcaactattttttcccagcctttggcttatcttttcattttctgaacagtgtcttctgaagagaactattttaaatttcgataagtctaatttatcctttttcaaaaatggtttgtgttatttgtgtcctatctaagaaaaacttgcctaaggaaagtggcaaatatgttctatgttttcttctagaagtgttattgttttagctcttacatttacgttgatgatctattttgagttaatttttgtatacagtggaaactgaggcttgaacattgaattatcctgtcacctttgttgaaatcaattaaccatatacttgcatgcacaggtctatttctagatgctcttttctgttccactgaactatgtgtttattctttcatcaagactatactgtcttgatattgaccttaatcctccaacttgctcttacttttcgaaactgttttggctgttccaggtcctttacatttccatatgaattacagaattgctggtcaccttatacaaaaaactgtctgctaaggttctgagaatatacggactctatagatcaattaatttggggactgttaacattttaatattgaattgtacaatccatgaacattgaatatcttgttaggtcttccttaatttctgtctacaatgctgtatagttttcagtaaacaggtttacacatattttgtcaaatttactcctaaatttttcatgtttttgcttctattgtaaatggtgctgtatttgttataataaattaattcccaattgcttgttgttaataaatgtatgtgcaactgctttttggatattaatcttctaactttcaaccttgctgaatgtacttattagttcatgtagcttttttgcagaatcttgaggattttctatatggaaaatcatgctgtctaaattgggaaagttttacttcttccttttcaatctgtacggcttttctttattttacctgatggcactggctagaacttctaagacaatgttaaataaaagtggtaagagaggacagatttgccttttccaatcttaggggaaaagcattcgtcttaaacaagtagatacaatctaaactgtaggtttcttgtagattccctttattggggaaaggaagcttccttcacttcctagtttgcagacagatattttaaaattgtgaatggatattaaattttatcaaatgctttttctgcatctactaaatttcctttttaaaatatgttaatgtggtaaattaagctaactgatttttgaattttatactaacttagtaatcctggcataaactatccttggtcatgatttttacctactgctacatatgactgccctaaaattttgttatattattctctgcatttttctccaatttaaaaattaaaataaattgtacaggtttaccagttaaaacagtttactttagatttacacttttatttcacttatttctactaaagcattaatgtctctatttataaaatatacaagcatacttaacattatgaaagcaacaaagtagcacagtttaaggaagcatgaatttcattcttgctagccattactttaaaaaaaaccatgccccaccctctgcctttgtactaaggagcatttaccccttatctacaccatctctataaatgccagttaccattaagataaatagtcaagcctctccatctttttagttccttcactatgttgtcaggtagggaggtaagcaactgtaaatattaataaaattttactgctatgtccataggacatgagaaataattaaaacttttatacttaaaaacttctcagttcagaatctggcaccatattcaaaaacgaaaataaaacaataattttttaaaaattgaaaaactaaaagatcataaaattaaaaaattctaatacaagatttcaaagtatagaagtgatttaaaaaatcaaaaagatatgactatttagaaaaacaaaacctttgtaataaaacatatataaccaaaattgaaagataacaccaaaaccaatcaaacttacatgtatcaatatttatagttcagaaacagaaataaataaagtaaggaggactttatgatctaaatcttatcaattctttaagattaaaagtttgaaattataagttatttaatcaaatttttaaatgataaaatccaatctaaaaaggagccttcggaaaagaatatctgtaaaatttaaatataaaacagctttcatggagaaaaattctcatgtctcagcagttactcaaactcaatgtgcagttattcaaactcaatgcacagttttttgaatacttattttaactatttttcatccctttctcttcaaaatattttggttctcctaacaggcatccaaattgtttctttcacacttcctactaaattctatgtagaaatcattgatgaaatcaccaaaaagtaaatagaagaaaaaataagggcttgaatgacataagtgaaaatgtagttatatgaagtctgtcattaacctccacaaaaaattacttacatctgcttaaaaagttgtcaatatttttgttttttcttaaggcaggaaaatccaaatcatataccaaagcatccaatccatcctaaagaaacaaacaaacaatggttagttttttggatcacattatacagtctccttttttatgaaagaataaaatatacgctttaatatttaatttcccctaacacatcttgtgtacatttaacaccctctacaaggttagatgagtactgggagaaaagtggttttcatttcatatgcagttctttttaccttctaagtctgccaggcccaggggcaagaaaattaccacagattggctgcaagtgatttcaatccatgcacttttcccctcataaggacatgaaattttattttgcattacttctccttactactgcatttatctttatcttagacatcaaaaacctacatttgttactataaatattttataaggtaacagctaaataataataaaatgtgaggtttaatataaaataaatactgcataatcacaaatgcaagctatatacatttttaattataaaaatgtattagattgtcatgggtcttctttctttctttgaggcactttctagggaaagctagcagtaaaggacacacctgagcttttgcattttttctgctttttttttttttttttttgagggtcttgctctgttggccaggctggagtgcagtggtgcaatgttggctcaatgcaacctccacctcctgggctcaagccatcttcctgcctcagcctcttgagtagcggggactacaggctcacgctaccacacctggctaaatttcgtctttttatagacagagtttcaccatattgcccaggctggtcttgaactccagacctcaagcaattgctcctgtctcagagtcccaaagtgctgggattacaggtgtgagccaccacgcctggccgaacttttgcttttaagtggatatttaaatattatctaagcaagtgcatggcagtgtgaaggtataccaagcagtgttgaagtgggaaagcatctattcagactatatcctgctgcatggcaggaactggaagaacttcagataatcctaagcaatcttcactataaagtctcactctttagtaaatgttgtttgtataattgaatagcactatggaaaagaatggtttttgcgtgatgcttaataatgtaatcagttccagacaggtcaaaacattaaaaaaataaagaaccaggcaaaagcattttaaagaaaaaaatagtatatttacatgataccgttgggagaacaagtcacataacctttctgagcctcagttttcttttttgtaaaatgagggataatgattacaacacataacagatttgtgagaattaaatgagttaacatgtgaagtgtctggaccttaatagtctcacttctctctcttttatttctgttactgacatttgaaagctctgaatgttagtctccctattaacaggaatgacctacacagaaaacagacattttagtcacgtggtcataaaaccttaaaagtaaatcttaggtcatgatgttaaacccttccccaatgcagtaatccaaagtacttttgttgttgttacacatgggcatctgagttttgcgtgaccaagtatttgatcatgtgtttgttaatgaaaaatgagctgcctccactaattacatatagtcactaagtgtttggacctggtaccacacactttaattctacaataccatgggatagtctattacttttcagcatcacccataagcaaaacttgtgtgcctttattagggaaataaagttggcaagaatgtattcttctaacttaaccaaagcatataccaactgaggtttctaaggggagtcaagacactggggtgggagagagggatgcaggcttccattttaatgcagtggaaaagctgcacaatgcaaggaatgtgtatgtccaactataaatgaggcaggaaccttagcttttattcaatactctgaagttccataaaataatgcagataagacttccacacttcctaaaagtccaaattctagtaccaggactcggaatgttaacataacattcatccaagtgcaaaaacaattcacgaggaatgataatcaaaggatatacttccactgatccttcacttaattttatgatttaggcatgagcaaaactaccttctactttcacaacatgtccatcatatagcttaatcatcaatttaaaaatgtagaggaggccaggcacggtggttcactcctgtaatctcagcactttgggaggccgaggcaggcgtactgcctgagatcaggagttagagaccagcctggccaaaatggtgaaaccccatctctactaaaaatataaaaattagtcaggcatggtggtggtgggtacctgtaatcccagctactcgggaggttgagacaggacaatcgcttgaacccgggaggcagaggttgcggtgagccaaaatcatgcctccagcctgggtgaaagagactccgtctccaaaaaaaaaaaaaaaaaaaaaaaaaaaaaaaaaaaacaaaagtggaggagaaaatatgtaacagaggggccaatcaatgtcaaaaaattacagtaattaaattctttgctactaatagttgaacaagggtagtagaccagttgtagcagttacattttaaaagaaggtagttacataagagaagtattttcacatatacacacaaaggcaggcataatcaattaaaagtataacattttacagtgatctctaaagtaaaaacacttcacatttcctgagaagcactgatatggcagggggagcagggggaagaggaggtagaggtccattgtgttatgccacaacagagttcaagtgaaagcagaagcaaaagaaaattattcaacactactacaaactttagttttctggataaatctgaattaacaaatatgagtcaggtgtaaaacatcatttaggattaaatccattaaaagtaacacattataaggtatgagaatttaatggcactaggaaaggacagttacactattataagaaacattcatttttaggtaaattttcaaaacctaaatggttattattctaaacctaacagacatatttttggagaaacaccaccccaccctcaaaatccattgaaaactatggcagcaaaactggggcttctgaaaatcaaactacttctaaaatgggctgaccactggtactaaagactgctgaccaactttggtaagagaggatataccatttaaagaaaatgtttttggtatatgtagtagaatgttgttttaactaagtcccttaggccagatgctgtggctcacaactgcaatcccagcactttgggagatcgagacaggaggatcacttgaaaccaggagttcaagaccagcctagacaacatagcaagaccctatctctacaaaaataaaagtaaaaaaaatagctgggcgtggtgccgcatgcttgcagtcccagctacttgagaggctgaggcaggaagatcgcttgagcccaggagctcaaggctacagtaatctatgattttgccactgcactacagccctggtgacagagtgggaccctgtctctaaaaatcaatcagtctgtcaatctctcttcacttgataaagaaataattcatcaaaattaagcacagctatgaaaatgaaaacagaatttccttagggaattttaacaacctgatattaaatacagttaaaatctgtttaactggtgtgacattactatacccatgtcaatgctgcccaggacatttatagtcaataaataagtaaataatgttccaaattatctagtacaacaaacaatggctcttcccaatcagtctccaatcatacctttgtccagcctgtttctctacacatacatagctgggcttaggccacagtgtgctaccagccatttcccaaataagccaggctcactctaccctatggggcctttgcacctgctctattctcccgctggaatgtgaacattcttacattaagactgcctcaaatgtcccttactttgtgctgccttccccagtgccctgaggggaaatgttacataacctcctttgtgctattacagaaattatgtatttagctgttatactgtaattatttatttctaaatctgcctcctcttctgcaggaaagcagaaaaaaaatacttcctgtctctcagagttcagaagttagttagtaggtagaaaaagtaaatacaggatatcaagtgttataagtaggtactacataaatagagaaaaggctatttggggcttcacagagaagatgaaatttgagctgaaccttgaagaatagaattatgaaggaataagacagaagtggggcaaggcaatctagaggtgaaaagcaacgagaattcagagaatgaggatagaatgttctggactgggaaaggtgagaaggagatgaaggagaaggagtcaaagctgtgatgatcagggagagaatgttaaaggtataacataccaggagaagaatttaccttctgataatttggaaccacaggaatttctgcgggggagaaagtggcataactggtttttattttagtagtctggcaatgataaagatgataaattaaaagtagaagagacaggtggagatgaaagcaactaggaggatactgtggtaatacaagcataaaaggataaaagactgaaaaactgggtaaacaggaatggggcattagaggcaaaagaatctgatgaataattgaaagaggaacaggaagggttgaaaatgattatatgatcttcaagttgatgtgagtagacagtgacttcattaaccaaggcagataatataatttggagagatgataaatatttcagacacactacatctgaggtcctttgggatatcatttcatgaataactagatggcagctgaatataagtttgggtttaacagagagattgggactacaatacagatttgggagtcatgagagcacacttaaatccatgagaacatatgcaatcatccaacaagaataaacagggagagtagagaaagactgaagaatagaacactgggaaacactaacatttaacaggtacacagagcaggctgggcatggtggctcacacctgaaatcccagtactttgggaggccgaggctggtggatcacctgaggtcggagtttgagaccagcctgaccaacatggagaaaccccttctttactaaaatacaaaaaattagccgggtatggggatgcgcacctgtagtcccagctactcaggaggctgagacaggagaatcgcttgaacccgggaggcggaggttgcagtgagccgacatagcaccactgcactccagcctggtgacagagcaagactctgtctcaaaaaaaaaaaaaaaggaaagaaaaaaaagaggtacacagagcaaaaatggtggaggaggacacagagaagaaagacagaatagtaccaaggaagctgagaaggaacttaaaaagaagaaatgccttaagaatgaatttaaaacatctcaggaagtcaaacagaatagagaatgcaaaagaagccaaatcatttgccatttaaacatcactgatggtcgcacaacaacgtgaatgattaatgccacagaactatacatttagaatcagttaaatgggctaggtggctcatgcctgtaatcccagcactttgggaggccaaggcaggaggatcacttgaggtcaggagttcaagaccagcctggctaatacggtgaaaccccgtctctactaaaaatacaagaattagctgggcatggtggcaggcacctgtaatcccagctattcagaaggctgaggcaggagaatcacttgaacccaggaggtggagattgcagtgagccgagatcgtgccactgcactccagcctaggtgacagagggagagtctgtctcaaacaaaaaagaaacagttaaatgataagttttatgatacgtttgtgtgtgtgtacatatatatacacacataaaaatttttgtatttgtagtagagatggggtttcaccatgttggccaggttggactaaaatttctgacctcaagtgatcctcccctcttggtacatacacacacacacacacacacacacacacacacagagccataatttattttaagtcactatcagatgtcagcaaattggtggactaggaagctccaagctctccttcaccgacagaaacatcaaaagtaacaagctatctgaagcaggtctgcaatagttctggaaaatttaggtttatagcaaaaaacaagcaaatatccaatcaagtaaaagctatcccaaatggtaggaaagtgttatggcagtttacttgctcttgtcccaccccctgccagagaaaaggacagtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaggacagtcttaagtcttgagcaggtagcagactggttcctcctcttcctactcccccacaccttgaacccaagagggtagaataagaccatactgtgtatgttcattctatcttgtatgggagatacctgaaggactaaggcaagaacctaaactctgtttcacataattcagaacacaggcaggaaaagcagctggtgctgctcataaaggctacaaggaagctaactacaaaacctactgacacacctgaggtaaaagatgggggagtagggaggactaatggacacaacacatacaatagaccatctaggcccagaggagaagtggggcgagacttttttgggaaattagatgattcaaaagcagccatgtatacaggagaatataaaaagccgtgtgaagcccaggcaaaaaaagcatgctaaggaaaatcctgagaagatcctaagctctcatctcatgtgagtttcatcctgaaactcagaacaagcctagctaagtggtaaaggagtaccccagcagagggcaaatctgcaaagactgagaggtggttctctttttgttttctgaggcttttttggtatgtattggagcatctcacattcaaggaaatctctgtccaaacattagctgaatacaagctaaaggaaccaagacttcagtaatcactcacagtaaggaatagtctttgcaaaaacaatttggaaaagtctcaaaacaaatggactgcagtcatttgtactacagccatcagcaataaaaaacaaactggccaggcacagtggctcatgcctgtaatcccagcactttgggaggccaaggcaggcagatcatttgagcccaggagttcgagaccagcctggccaatatggcgaaaccccgtctctactaaaaatacaaaaattagccgggtgtggtggcgtgcgcctgtggtcccaaccgtttggggggctagggtgcgagaatcgtttgaacccgggaggcaggggctgcaatgagctgagatggcaccactgcactccagcctgggtgacagagcaagactctatctcaaaacacccacctacacacacacacacacacacacacacacacacagagagagagagagagagagagagagaacctagtgtggtaggagttattaagaaattattttaggcagatagagaggaaaaaaaagggtcctttggaaggtttttcgcagctcttgtctagcaggaaagcccggggcacctgtgctgtaatggcagtctgagtggatggagtttgagctctgggacccatcagtcctgctggaccatctgtgagactagttctgaacccagaacaaaagaccaaagcaggtctgtctccagtagtctccaccacaggctggacagggtcaaggtggctttgtcttgcttcctgggcattccttcttaaaatgccctgactgaccacattgataacagctagtggatgcaccttggggattcaggactttacaagcttgtaatgctgctactagagcctctgtttttctcttgtacttcctctccttttctcgggcctcctcccaatcccttttgtaaaagactgaagtggctattctcaggaggctttctagggtgctatctggttctactgcttgcttctgtagctttcttctaatattgggagctgcctgtgtaataaacttgtccttcaggatgagctgtccctcaactaaattggggtatagagaagtgtgctttattagtgcccctctcagcctttccataaaagctgtgggattcttgtctggtttttggtctatcatggacagtttggagtaattgagaggtttagctgtggtctttcgcaggccttctaatatacaccttaaaaagtgcttccttttccattcatctgctgagttattgggatcccagttagggttatttaccggaactgcttcccttccttgcaggagtgaagttttcacctcttcctcaccttccttttctcctctttttttccttggtctgctgtatggaggcatgttgctcacctccatatttttctgctgcctgcggaactgtctgcttttcagctgtagtgagggtttaacttagcagcaacataacatccctccacgtgagatcaaacacctgagttaaatttcagaaaatttctatatacctatcagggtcatcagaaaattgacctaagtctccctttgtttgcttaacgtcctgcaatgagaagggaacttgaacccttatggcaccattcccatcaggcatttcctggaggggtaagagtgaagaggggagagtaggacatactggagatggtggtgctgatggtacaactggagtggaaccggaagggttgggacttcagtagctgtcttagattgctcctctggagcccgctttagctctggggaactactccctgtgggtttgcctgccatggctactaaaagaactgggtcgattgtacagaacttgtaaaggtctgggttgtctcgcagagcaaagaaagcctgtacataggggacctcagtccatttgccctcctgtgtgcagaaaagttctaactgttggataatattaaaattaagtctccccaggccaggtttacgaagaggataggaaggccatgcccttgtgcagtagaatactgctttttcttcaaagttttagggtcgaaggagtcccagtgctttaaaatacactccaggggagtgcatgttgaagacgatctgttacccatctagaaagagaagtgagaacaaaagcgttctccttcctttcggtatgtgatccacgtgtgttcctgtagtttttttctaattcgactcgagacgaagaccctggtgttcccccactcatcaaagccatatcactagcaaaccctggagaatagagaaaatctaatttccaaaatcaccacattataacagttaaacggccaattttccataaagaaaccacaagatatacaaaggaacagaaaaacacggctgggaggaatgaaataaatgaacagaaaccatatccaagaagcccagacattggacttgataaagacattaaaaactgtcttaaatatgttcaaagagttgaaggaaaacacagaaaaggaactaaaggaaactaggaaaattatatatgaccaaaatgagaatgtcaacaaagagaaagaaactatattaagaaaccaaacaaattctggagctaaaaactaacactttaagtataaatggactaaactctccaatcaaactacagagactgacaaaatggattttaaaaaacaaacaaaaacaccatgatccaactatatgctgcccataaggaactcacttcaagtccaaagacaaatggttaaaagtgaaagatgggaaaaaatactccatgcaaatagtaaataaaaaaagcactgaggtgggtaggctaatatcagacaaaacagaccttaagttaaaaaaatggttaacagacaaaaaagacattacatattgataaaagagttaattcaccaaaaatatattatcataaatttatatgcgtcaaatatgtacatttggtatataaatatacaagccccatgatatgtgaagcaaacattgaaagaatttaagaaagaaatacatagttctacaaatagttggagatttcaataatccattttcagtaatgaatagaaccagacagaagattaataaaaaaacagaggacatgaacgacactataaaccaactggacctaacagattataaagagagagagagcactctatccagtaacaaaatacacatttttctcaagtacacatggaacattctcaagaatagacttattatgttatgccacaaaacaagttttaataacttttaaaagaccaaaatgacacaaagtatcttttccaatcacaatggaatgaaactactaaacaataataggggaaaactggaaaattacaaacgtggaaattagacaatgaactcttaaaactatgggtcaaagaaaaaatcattgggaaattagaaaatactttgagacaaatgaaaatgaaaatacaatgtaccaaacctagtaggatgctgaaaaatcagtgcaaaggaggaaatttatagctataaatgcttacattttaaaaagaaaaaaagcttttaaaatcaataaaaataacctaacttaatactataaggaactagaaaaagaaaagcaaatgaaacccaaagctgacagaaggaaagaataaagattaaagtgaagataaataaaacacagaataggaaaataacagagaaagccaatgtgacccaaagtaggtcttctgaaaagataaaattggcacatatttggttaagctgactaagggaaaaagagagaagactcaaattagtaatttcagaaataaaagtgacgacattcctatcaattctacaaataattgtaatagaatattatgaacatctgcacaccagaaaaaaagggtaacttacataaaatggacaaattcctagaagcatacaatctgccaaaaatgaaccataaagaaatggaaagtcagaatacaccaataactgtaacaagtaagaagacagaaatggtaataataaacctctcaagaaagaaaatccctgggccagatggctccactggtgaattctaacaaacatttatgtatttttatttgtttgttttttcctttttttgaggcagggtctcactctgttgcccagggtgaagtgtaggggcacagtctcagttcactgcaacctctgcttcctggacttcaagctatcctccagcctcagcctcctgagtagcttgtgtgagcaaccacacctggttaatttttttttttagggatggggttttaccatgctgcccaggctggtcttgaactcctgagctcaacgttatttgtttgccttggcctcccaaagtgctgggattacagattgtgagtaggcagtatgtccggcctctaccaaacgtttaaagaagaattaacacgaatccttttcaaactctttcaaaaaactgaagagaaggaaatatttcctaactcattctatgagtgcagcactgccctgatagcaaaactaaaaatatcacacaaaaattacatatcagagtttatgaaacatatgaatatagacataaaaatgcccaataaaataacagcaagtagaatatagcacatatgagaagaagtacacaccaggatcaagtgggatttatgccaggaatgcacagttgatttaacatacaaaaatattttaatgtaatctaccacattaatagaataaaggacaaaaaccacatcacctcattagatacagataaaatgttcaacaaaattcaacaccctctcataataaaaaacaatcaacaaacagggaatggaaagaaacttcctcagcatggtgaaggccacatatgaaaatcccacagctaacatcatactcaatgatgaaagactgaaagcttttctcctgagatcaggaacaagacaaagatgtcaccttttgtcacttctattcaactcattattggaagtttttgccagagcaattaggtaagaaaaagaaataaaaggcatccaaattggaaacaaagacataaaattatctattcacaggtgacatgatcctataggtggaaaactaaagattacacacacaccaaaacaaaacaaaacaaaaaaatccgtcagagcccataaccaaattcagccaagttacaggttagtcaatactcaaaaatcagttgcatttctatatactaacagtgaataatccaaacagaaacttaagagcagtttcatttataaaagcatcaaaacaaataatactgaagaataaatttaactgaggctaaagacatgtacactgaaaaccataaaacattgctgaaattatagaagacataaatgaaaagacatcctatgttcatggactggaaaaaatattttttttaatggcaatactactcaaagtaatatacagattaaatgtaatccctatcaaaatcccaatggtgttttttgcagaaatagaaaacctcatcctaaaattcaaatgtaatctcagatcacaaatagccaaaacaatcttgaaaaagaacaaagttagaggactcaaattcactgacttcaaaaatcactacaaagctacagtaaccaaaatggtgtactgctggcataaggacaagcacatacagctggtgctcaaacaacataagtttcaactgcatgagtccacttatacctccttccacctctgctacccatgaaacagcaagaccaactcctccttttccttctactcagcctactcaatgtgaagatggtgaatatgaagacctttatgatgatccacttccatttaatgaacagtaaatatattttctcttccttatgattttagtaatattttctttttgctggctaacattatgtaagaatacagtacatatatttacatataacatacaaaatacgtgttgttaatcaactggttttgctatcagtaaggctttcagtcaacagcaggctattagtagttaagttttggggaaattaaaaaagtatgtatttcatgtatttcaaatgtatggagagagggtagtggtcagtgcccctaatccccatgttgttcaagggtcaattgtgcagaaaaatggaatggcggggggaaaaggggcacaaacccacacatacatatggtcaattaatttcaacatgtgtgacataaccattcaataatggacagtctttttagcaaatggtgctggaaaaactgcatatccacatgcaagagaatcaagtgggagcccctacaatataccatataccaaaattaactcaaaagggatcaaagaccaaaacataaaagctagaactataaaatgcttagaagaaaacatagggggaagcttcaggacattgaatttgaccatgatctcttgtacatgagaccaagaacacaggcaacaaaaaaaaaacaaactaaacctcatcaaaattaaaaacttttgtgcatcaaagaacagtattaacagagtgaaatggcaatccacagaatgggagaaaatatttgcaaataatatatctgataagagattattacgcaaaatatgtagggcactcctaaaattcaaaacaactcaattttaaaatgggcaaaaacttgaataaaaacgtctccaaagacagaaatggccaataagcacatgaaaagatgctcaacatcataaatcattagggaaatacaaatcaaaaccacaatgaaacatcacttgacacccattaggatagttattattttaaaaaatcagaaaagaacaagtgttagaatgaaactggaatgaaacgtaatgaaactggaacccttggcaatgctggtgggaatgtaaaacagtgtagctgctgtgaaaaatagtgtatcagtttctcataaaattaccacctgatcagtaattccacttctgggtatacacccaaaggaaccgaaagaagggattcgaacagatatttgtacaccaatgttcacagcagcatattcaaaatagctcaaggtagaaacaacacaattgtacaccaacagatgaatggataaaaggtggtatgtacatacactgtagtattattcagccttaaaaaaggaaatgctgacacatactacaacatagataaaatctgtaaacattatgctaaatgaaataagccagacaaaaaaggaaaaatattgtatgattccacttatacacagtacctagaaatggcaaatttacagaaacagaaagtagaatggagattaccataggctggagggacagggaataaaagagttactgtttaatggatacagagtttgtttgagacagatgatatagtgcaaacagatactggtgaaaacacaaaattgtgaatgtgctttaacaccaccaaattgtactcaggaacagttaaaacggaggcggatgcagtggcatgcacctgtaatcccagctactcaggaaagtgaagtgggaggatcgcctgagcccaggaatttcagagcagcttggacaaccccatttcaaaaaaaaaaaaaaggcaaatttcatgttacgtatattttactgccaatttttaagggcattattaatcttaattagaatgcttcgttagaggagaaggtgcacataccagcttatggttggtagaaaaattaatggaaaatgaagaaatgagaaaaatggctaaataaatgagaaagactagaagtttgcatgatttaaaacttaaacttgatgaaacatttttaggtagaaaagatatttttatagaagatacatgatttaacaaggttccaaaagatgtaagggagaacaggcttaagataccaagttaagacattaaccttgtaaagtaagagaatacttctacagaaatggcatcctgtctcatattccaagctagaatatttagtagtcatgtgatcttgagcaagttatttaacccatcaccacctcaatgttctcatctgtaaaacaagatagtatcagtaacaaccacacaggactgttttttattttttaaagatttatccaaatgagtcacaaaaatatattcacggataatttcaaggaggatttcctccctactgccttaaagttttataggtatgggtgaacacaatcaaagttttctcctggcatgagtaactgaagaagttcagatggttcagactttggggagagagagtttgtcatttctcaaacgattcttttaagtatctaatttgttattttggggaaaaataaatacatgtcatacattctttggttagtagtagtatggaaataattttttttttttttttttgagactgagtctcactctgtcgcccaggctggagtgcagtggcgcaatctcggctcactgcaacctccacctcccaggttcaagctattctcctgcctcagcctcctgagtagctgggattacaggcatgcaccaccacacctggctaatttttgtatttttagtagagacaggatttcaccatgtgggacaggctggtctcgaactcccgacctcaagtgatccgcccacctaggcatcccaaagtgctgagattacaggcgtgagccaccgcgcccagcctgaaaataattttttaaaactcagctaattgttattttcttaaaattcttatacaaattatcatacaatcagaccttgatcatggaaaagaaaatgaagagaatcattcattttccatggaactataacaaaagatttaacatttgtatcactggatgcccagaagacaaacaagaaaaatagaatggggctaaaagggactaaaacaaatgatggctaaaaattccccaaatttggcaaaagacataaacctacaggttgaaggagctgaccaaacatcaaaacaggacacacccaaagaaacctaagccaattttttaaaatgtcaaaccgaaattctacatccactgaaaaaaaaaaaaaaaattaagacattctcagatgatgaaaaaccaagagatttgtcacaagcagacattctaaaataatggttaaaggaaattctctaaatagaagacgatgaaagaaataaatctggtatatcatatatcagaaaagaagaacaaaatgtaaaaatatgggaaaagataatacatttttcttgtcttgaaagttaaagcaaaaattataatgttgcttgtttctcaatgcatgtaagaagatattaaacatgaatatattacgaacaagggtaaaatgacaaaaaggaggaaaaatttctacctttcaattgaactagtaaaatatcaaaaccaatataatgtgatgttttctatgcctaatttaatacctagagtaaccaatttaaaaagctatacaaagacatatacacacaaaaacactttcagataagtcaaaagggaattacaataaatgttcaagtggcccaggaaggcaaaaaaggaacacagatacaaaaaacagggaggtaaaaacagaaaagaaagaatataacagcagatttaaaccctaacataacaatagttatatgaaatataaatggtctagacaacaattcaaattaagaaacagattggtagacctggatacataaacatgacccatccacagacaagaaattcacttaaaatgcaacaatacaggtaggttggaagtaaaagaatgggaaatgatttaccatgcaaatattaatcaaaagaaagtgggtgtggctatattagtgtcagacaaggcagacttcagagaaagaaaatggccaggcacagaatggaaaattatatgatcacaaaagagtcaatccaccaagaaggcacaataatctgaaccatgtacgctcagaacaacagaactgcaacacaagtgaagcaaaacctgacaaaaatgaaaagagaaatagacaaatctacaattttagtcggcaacttgaatacttctctcttaaaaattgatagaactgggcacaaaatcatcaagaactcaacacaattaatcaacaagatctaattgacatttatatcacattctaacccaaaatagcagaatacacatcctttacaagtgctcatggaactattaccaagacagaccaccacattgtgtgccataattcaaacctcagcaaattaaaaagaattaaaatcataacagaatgtgttctttgaccaaaatgtacaaactacaataaataagaaaaagatagtagggaaatctccaaacacttggaaactaaacaacagatttctaaataatttctgggtcaaagggaaagcctcaaaggaaataaaaatatacattgaactgaatgaaaatgagaacacaacactggaatttgtggaatacagctaaatcactgctaaaagaaaaatgtatagcattaaatgattagaaaagagtaatgatggccaggcgcagtggctcaggccaataatcctaatactttgggaggctgaggtggaaggatcacttgagctcaggagttcaaggcccatctgggtaacaatagaaagacctcgtctctacaaaaaaatttaaaaattagcggggcatcgaggcacacgcctgtggtcccagctactcaggagaggctgaggcagaaggatagcctgagcccctgaaaggtcaaggctagagtgagctatgatcacgtcactgcactccagtctgggtgacagagtgagaccctgtcttaaaataaattttttaagaaaagaaaaagaataataattttcaattaataatctaagttcctttctcaagaaactagaaagggatcatctgaacaaatttgctatggtctgaaagtgccaaaattcatttattggaaacttaatccccagagaaacagtgttaagaggtggggcctttgggaaggtgtaaaggtcatgagggcagagtccttataagtatattaatgccatgatgaacaggtttgattagggagtttggaccctttttgtccttttgccttctaccatgtgaggacatactgacccctcccttctggaggatgcagctttccaggcaccttcttggattcagagactagaccctcatcagagaaccaaacctgctggtgccttgatcttggtcttcccagactccagaactatgagaaaacaaatttccgttctttataaattacccagtcttggttctgttatagcagcagaaataaactaggacaggaatttaaaaaaaattcccattatatgttattataaataacatattttattaaaactttttttttttaagacggagtcttgctctgttgcccagactagagtgcagcggcgcaatctcagctcactgcaacctccactggttcaagaagttcccctggttcaagaaattcccctgcctcagcctccaagtagctgggattacaggggcacgccaccacattcggctaatttttttctatctttagtagagacggggtttcaccatgttggccagactggtcttgaactcctggcctcaggcaatccacccgccttggcctcccaaaatgctgggattacaggcgtgagccaccgcagccggcctaaaactttttttaattgggaagaagaatggcattatcttacatttttacaaatctctttagcatctagcttaatagaagacaactggacactcatatctgcgcctgcattcaatctatgacaatacattgccttggtttgaagcgtgaaaatctaacttcacacagatatggacagatgctcctagacttataatgggtggggtttacatcctgataaaccacttgtaagttgaaaatattgtaggttgaaaatgcatttaatacatctaatctgctaacatcatagattagtgtagcctaccttaaacatgttcagaacacttacatcagcctacagttgtgcaaaatcatctaacacaaagcctattttataacaaagtgtcaaatatctcatgtaatttattgaatactgtactgaaagtgaaaaacagaacggttgtatgggtactcaaagtacggtttctactgaatgcatatagctttacacacaccatcataaagtggaaaaatcataaagtgaaccattattaagtctgagattgtagttggaaaagggaagagtatgttaacagtcttttcagataactggaaattatttgctactacatcaaatttgacgaggggtgtttcttaaagattagtggcattgtagaatctgaaattatatcaatggtttctgaactttttgcacagtttgcaacattaaaatttattggtctatcttctactttgaatggatcttttattcatggatgattttataacatcatgcattgattggtcacttagaaaatactggttccttgaattatgcagccaaatgttgacacatttcatcacatctgtaaccccaacactttgggaggccaaggcgggaggatccctcgaacctaatagtttaagaccagcctgggcaacacagtgtgaccctgtctctattaaacattcaaaaactagccaggtaaaattagcatgcctgtaatctcagctactcaggaggctgaggtgggagaatcacttaagcccaggaggttgaggctgtagtgaatcatgatcccaccactgcatacagaagccaaataaagtgattccctttatttttgagactctgtatcaaaaaacacacacacaaaacaacacattattggcttttggtccttcattcaaaattcaagaggtactggggtggggagcagaatatctatattttcatacagacctcctgcagttttaaaatgttatcccccggataggtacagtttacatttaaacaaattatcaattatatcctattccctaacatgatgtcaaccatcttcagctcttgttacagaaacaaataagcaaaagatattttccagaaattcgacaacaacaaataaatgtttattgaaaacttataatgtgccaagcagggctctaagaaccagtgatacaacagtgaacaagacaatgagatacctgttctcacagagcttacatgtaagagcatcagtatctcaaagtacaatagatcagaagcataaaagctaagtaagcaaaatttattaccatttagggaaaaaaaattaatctcataggaacagtaaatttttaaacctttttaatctgtgaaaatatctgtttttctgtaacagttgacccttaaacaacatgagttggaactgcatagatctacttatatgtggattttttttttcaataaaatatacaccgagtatgcctctcttgcctccccttccatctcttttacctcttccctctctgccacccctgatacaaagaccaatctctcctcctcctcagctactcaacatgaagataacgaggatgaagacctttatgagatctacctccacttaatgaatagtaaatatattttctctcccttatgattttcctaatattttcttttctctagcttactttactgtaagaatacagtatataagatatataatagccaggaatggtggctcatgcctgtaatcccagcactctgggaggccgaggtgggtggatcacgaggtcaggagttcaagaccagcctggccaacatggtgaaaccccgtctctactaaaaatacaaaaatgagctaggtgtggtggcacgcacctgtagtcccagctactcgggaggcagagacaggagaatcacttgaacccaggaggcagaggttgcagtgagtcaagatcatgccactgcactccagcctgggtgacagagcgagattccatctcaaaaattaaataactatgtacatatatcacaaaatatgtgctagttgaatctttacattagtaaggctgttaattgttaaatctggggctgggcagagtggctcacacctgtaatcccagtactttgggaggccgaggcgagtggatcacttgagcccatgagtttgagaccaggctggcctacgtggtgaaacccgtctctactacaaacacaaaaattagcccagcgtggtgtcgtatgcctataatcccagctactctgaagactgaagcccaaggatcagttgaaccgggggtgggcggtggggcaaaggttgcagtgagccgagatcatgccactgcactccagcctgggcaacagagcgagacgctgtctcaaaaaataaataaaataaaaaactgttaaatttggggaggagtcaaagttacatgcagattttcaattattaggggagtcagcacctctaaccaccatgctgttcagggaccaattgtaaaactattattttatagcctcttcacattaaaataatgtcttcataaattactaaacagccaatcccttccttttgacaggtgaaggaacaaggtattggagagttacaatgatgattaagggaatctctttatttggcttctgtataaaatttgattttcccttccccactaaaaaaattggatcaaccaaacaaaataaaacaaaaccggccaggcactgcttgtaatcccagcactttggaaagccaaggtgggaggattgcttgagcccaggagttcaagaccaggctgggcaacatcgttaagacttcatctgtactaaaatgcaacaaagttagccagctgtgatggcacaggtctgtagtcccagctactcgggaggctgaggtgggaggactgcttcagcctgggaggtcaaggctgcagtgagccatgatcgcaccactgcactccagcctgggtaagcaagacctcatctttaaaaaaaaaaaaaaaaaaaaaaaaccaacacaacttctttttagcaagtgtcagaaaatgctcatcctcttcatatagcctggcattttttaaaccacattttttaaaagataaaataatttattaaatgggaaacaagactttttcttcaattctcatatggtggagctgtgatgaatcacaagaatctgtatttggttctaatgtgactggatccatcaacaggcatttggtaatcctcactatgacatatcatcaaggcaatgcagcacacaggtatccctctcttaaaggtccaagtgtatctcagttggtggtcttaagttgaggtttggcaaacggctggcaatatttattttaatgtcagataatttaataatggtaaatgaactccaatttccacccctccttcatgcaaccgtaatgtatcttggtataagctggctcttccccagttccaagactggagcacatgatgcagacctatgctcatcagcacaccattattttgactgagattgattcagatatgggtacattatatctaaattggtcagatcaattagagattctatttgaaggtaagaagaaaagactttttccactgtacctgaacaaatagtcttagaagctactggcactcgtcttgtaatcacaagttctctggtggacaacaccaaagaagccgatctggaaaaccagctgcagtcacatcatttgcaaaacctttggggccaggccaaataagcacagggcacgttgtgagagaccaaggtacagccacttatcaccaggttactctattgtttttgtgaagtttcaaatgctgctttctaaattatctcatttagtcctcctcagtaccccatgaaataaattattgttaattcaattttacagattgagaaaactgcactttagaagagtgtatatgacttctctaaggacaaagaggaaagaaagggtagcataatgtacacctacggcactgtctgccctgccctactgccctcattttcctgcaaactgcctccccattctcaaagttctcatgtgaccctacccgcctgatcacaattaattagtcaaggagccaggcacgatggcttacatctgtaatcccagcactctgggaggccgaggcaggcagatcaagacttggttaggagattgaaaccatcctggctaatatggtgaaaccccatctctactaaaaatacaaaaaattagccaggtgtggtggtgtgcacctgtagtcccagctactcgggaggctgaggcaggaggatcgcttgaacctgggaggtggaggttgcagtgagccgagatcatgccactgcactccagcttgggtgacagagcaagactcaatctcaaaaaaaaaaaaaaaattagtcaaggagtgggcacctggcaactgacctaaatgtaactaatgaatcttttcctccagagctctatactcaagactcaaagatctgaagtcaatggtcaaagctgaagctgttagatataaagttccagtgctgtaggcagccatattttccacatgtgactaaaaccagtctacaatctgagagaatgatgccaacacaaagaaaaacgtaagagaacacagagaatgagccttgcttgcatttaagcccaaattctagtttttactgaagttcaacttaatctttacctttaatgagactaggttttcctgaatccaaaattcttttttaaagaatcaacaaagtgaggaggcaacctaaagaatgggagaaaatatgtgcaaacaagggattaataactagaatatataaggagctcaaacaactcaggagaaaaaaagtctaataatccaatttttaaatgggcaaaggatctgaatagacatttctccaaagaagacgtctatcatgcctataatcccagcactttgggaggaggatcattaagccgaggagtttgagaccagcctgggcaacatggcaaaaccctgtctctacaaaaaaagaaaaaaaaatacaaacattggccgggcatggtggcacgcacctgtagtcccagctactcaagaggctgaggtgagagaatcatctgagccagagaggtcaatgctgcagtaagccatgaccccaccactgaactccagcctgggcaacaaaatgagatcctgtctcaaaaaaaaaaaaagatggccaggcgcggtggctcacacctgtaatcccagcactttgggaggccaaggtgggcagatcacctgaggtctggagttcgagaccagcctgaccaacatgaagaaaccccatctctactaaaaacaccaaaaaaattagccaggtgtggtggtgcatggctgtaatcccagctactcgggaagctgaagcaggagaatcgcttgaacctgggaggcaaaggttgcggtgagccaagactgcgccattgcactccagcctgggcaacaagagggaaactctgtctcaaaaaaaaaaaaaaaaaaaaagacatacaaatggcaaacaagtatatgaaaaggtactcagcaccactgatcatcagagaaatgcaaatcaaaactacaatgtggtatcatttcaccccagttaaagtagcttttttttttaatccaagaggcaataatgaatacaactgaggatgtggagaaacgggaactctcctacaatgttaacgggaatgtaaattagtacaaccactatggagaacagtttggcggttcttcaaagaactaatcaaactacccatagaatccagcaatcccacttctaggtacatatgcaaaagaaaagaaatcagtatagcgaagagatatctgcactcccatgtttatcataccactattcacaacacccaagatatggaagcaacctaagtgtccatgatcaatggacaaagaaaatacggtacatatacacaatgggatattattcaaccataaaaaagaataaaatcctatcatttgcacaacatagatagaactcaaggtcattacattaagtgaaataagccagacacagaaagataaatctcacatgttcccattcatttgtgggatctaaaactcaaaacaattcaactcatggagacagagataggaagggtagtaggggagaaagggactggggggatagttaatgggtacaagaaaaaaaaaaaactagctagaaaaaatgaataagatctagtatttgatagcacaacaggctaactatagtcaataataatttaatcatatatttttaaataactaatggagaataattggattgtaacacaaaggataaatgcttgagaggatggatacctcattttccatgatgtgattacacacagcatgcctgtatcaaaacatcccatgtaccccataatatatacacctactatgtatccacaaaaattgaaaattaaaaaaaaaaataagagtagaatcaaaacattcttaacacaaagaaatggcaagtgttgtaggtgatggatactccatttaccctgatgtgactattatacattgtatgcctatatcaaaacatcacatgtaccccataaatacatatatctactatgttcccataaaaatttaaaataaagcatttttaaaattattttttgtctacgaattttttttttttttgagatggagtctcactctgtcacacaggctgaagtgcagtggcacaatcttggctcactgcaacctctgcccccccgggttcaagcaattctcctgtctcagcctcccgagtggctgggattacaggcgcctgccactatgcccagctaacttttgtatttttagtagagacagggtttcaccacattggccaggctggtcttgaactcctgacctcaggtgatctgcctgcctcagcctcccaaagtgctgggattacaggcgtgagccaccatgcccagcctgtctacaaatatttatgttgggttctatcacttacaactgaaagagtcctaactaattcagagaaagaaagggaaagaacaagagaatggaaataggggagataatcattcacaataattaatgagcattattgaacatgatgtctagaattattatgtttagcccacaaggaattctcattaggtatgattaacaaacaagatagccctataccagataggtatgatcaactaattcagagaaagaaagggaaaaaacaaaggaatggggaaaggggagataatcattcacaccaatcaataagtaatactgaacactgatgtctagaattatgcttagccctcaaggaattctcattaggtaagattaacaaacaaaatagccctatacaagacaactatgatcaatttctaaatttcatgagactacaggagttcaaaaaagaaagtaacagtttaacacagttgtgatttatgtcagactataaagatgagaaaattgtgtgaggaggacatgggggagaactcaaggggagagaaaggtaggtcctggaaatacgacagcaaaagtaggaaagagtaggtgagatactatagaaagcaagaaaatccagtagagcgcagtctattttgggaaatgctgggaataaagactaagtaaataggtacactgagaccacatgacaaaaagcaccaaagttaagaaaagatgtagtatagattatattggaaagctgctacgctgtcccacaaatccaagaatgttgggatgaaaatttggatttgggtagtgcagcagtaacaaaaagtaaagatcagattcagggaacatttcaaataaagtatcacactctactttacccccaagtagtatttttgcctatactggaaccttcatccaacctatactataaaagtaaacaaaggaaaagaattaactactaatacttgtatgtaaccatggcaccacctataaattatttcatttaatcctcctaattaagcctatgacgtattatcatgattctcattttgcagattaaatatattcagactcaaaaaagttaggtaacttgtccaagattacacaactaaataaaaacctggccagcagagctgggagatagataataatccacttagatcaaaagtagtttttcccaaggacaaatcataaggatatataatgatgacgatgattacaaacagctaacatctactaaatgttgtgaactctgcaaagcacttacatgcattaccacgtttaatactcttaagagttctatgagggtctatgattaatcttatttgaaggtgatgtgtttgagttcctcttaagaactttacccaaagtcacagggctaataagtggtcgacctgggtgggagtgaaaaatcccagtctgactccagaattcatgcctgacaaggcagttctgctggtgtcatgtaatccttacaacaatataaggtaggcatcatcatcccatttcagagatgggataaatggatatcacagtgctttagtaaactgtccaaggaccaagggctagtaaacaacaaagccagggttggaagctagttatccctaaaaaacacccatgtgcttcaatgtgacggtgtatgtgcatgggagagcaggggtggagatggccctactagacattttaaaagctgaagagatattagaaagcctttataattgacacagtgtggtattagcacatgaaaaagcaagagagaccaatggaacagaaggttagaaataatcccaagtacacatggaaatttaatatatgaagaaagtggcattgtcaaccaacaaacataggcatttttaaaataaatgctgtggagataaacagatagccatttgaataaagataaaattggatgtatctcaaaatttaccatacatgataaattccgagtagatttcaaagtaaaaactgaaaaaaacattaagcatcagagaaaatatggatgaattcctttatgatctggacataggggaaatctttctaactatgactcaaaattttgaagcaacaaaagattgataatttggagacatttaaaaattgtgcggcaaagtaacaaaatgcagaagcaaagtctaaaacatgaaaaattgcaaaaaaaaaaaaaaatctgcattttaccacagaaaaagggctaagctccctaatacataaagagcttctaaaaactgagaagaaaaacaatttaaaatgaacaaaaaatatggacgggcagatcacagaaggaattcaaatagcccttaaaatatgaaaagatattcaaccttactcatgagaagaacagaaattgatattaatgttagaatagaaaaaatagaaaataaaattcaaattcaaattatactgaaatagcacttgtcacctattaaatggacaaaaattcaaaagtcttacaacatattgttggtgaggacaacagacaatcccatatcattactagtggaaatgtaaaatagcacaactcttaggagagggagaatattttaacagtgagcaaaattatatatgcatgtgtctttaacccagcaatctcacttctaggaatctactccaaagacacactggtaaaaatataaacaactcaaatgtccatccataggagactgaattaacaatgctaacacccacaaaatggaacaggactcagctgtaaaaaggaaggaggaaaatcatacaccaatatgtaacatgctactttttgcgtaagaaagtgattaaaaaagaatataaatatatctatgtatatatctatgtatatgtgtatatggatacatatttgcttatatttataagaataaacactgaaatgtcaaatcaaaaaaaagagtaaagggaaaagaacagggtagagagacgtggatcaaagtaagaatattctgaatatatctgatatagttttaacttttaaaccacgtaaatgggcctggcacagtagctcacacctttaatcccaacactttggggggttgtggtgggaggatcccttgagcctaggagtttgatcctggcctaggcaacacagcgagactccatctctacaaaacatttttaaaatcagccaggcatggtaacacgtgcctatagtcccagccgctcaggaaactgaagtgagagaatcgcttgagcccaggaggaagaggctgcagtgaaccgtgatcatgccactgcactccagcctgggggacagagcaagaccctgtctcaaaaaacaggccgggcgcagtggctcatgcctgtaatcccaacactttgggaggctgaggcaggcaagatcacttgagctcaggagttcgagaccagcctggccaacatggcaaaaccctacctctactaaagatacaaaaattagccgggcatggtggcacatgcctgtagtcccagctactagggagactgagtcagaagaattgcttgaacctggagggaggaggttacagtgagccaagatggtgccactgcactccagtctgggcgacagagcaagactgtctcaaaacaaaaacaaaaaaacccaaaccaaccaaaaagcatgtaaatgtttcacatacacaataaaataaaattacatcaaaaagtaaagaaagcactttttaagtactggaaaaaaagaaaaaaaaaaaaaacctaaaatgaaagagcctaactgacaagaagttggtgaaataatcagtcactttttcttcttctcaaaaataaaatatcatagctctattcactgaacaaggacaagaaacaatttcatccaatagtaaagagtagcattccccaccaaaaggaaagagtttcctggaggaatggctgatttccaagtctgaggcaagaaatgtacaagatgagcctgagtaccttactgcagcaaaaaaaaaaaaacaaggaagctctatcaaagataattagggtcatatacaaataacatgagaatcaacctgaagaagcccccatcagccaaagacaggacaaactgagtatcagcaaggatgacataaattgactgaaaacacaccaaaaatatttttaaatgtgtttataatgatgccaaaaatttaaaaaaaaaaaaaagactgagagcgaaataaataaataaatgttggttatgtcttgtttgtgactcatatggatcatatcaacaggctcttttgcatattagcttttcaggtaatgggagatctcagaaggagactgcatgtagggagggaggagaataagggtaggggatatattcctctgtctcccttaatacttgatccacaagctcctctttacttgaaagcacactccccatcagacagacctcttccatagagctaccctcctcagctgctttcctcttccctgtttcctgctggccttgaggcgatcgcaactcccttcctcactgtgactagtcacagagcactgtaccatccctaccagtttccttaaatattatctatacctttgtaaacagtcctttacttaaactcccctcaagttacccagtttgtggcatatctatcataataagtctccaaaataccttgctataacaagtggcaattaaggaaaagattgaagtattcatcctgtatttcatgaattggatttcatggtaaacatacagccctagttgatattaatatgtaaaagttctactcttaacagaggaattacagttaataaatgtgaaaggaataacagaattagaaaatcattattttgctattccctaatgaaataacagggattcagttaaagatcatgaatgaatggaaccattagatgaaaggttaatgaacgattcttacaggaagctatcacagactgatgccacctgaacagaatgatcaaccttagcatcactacaggccaggcagacattatgcacctccgtgtgaggcaaaagaaaatacaatctattgagtacccttgactagaaatctgaaataagtaaatcaagcttttagatctaactaccattttataggaaatatggaaaatacaggaagaagttaaattacatcattaggaaagtaaaaagaaaaatccagaatgtaaaacaaggtcctgtatagtaccactgacctagttccttcaacatgcaggggaaggggagttggagaagttgggggaatgagatttctctatattaagagacttaaaagactcttaaaggacctaaccaaagaaaagcaacatttggactttggatccagattctaataaagcaactgtaaaatagacactgttttagacaatcagaaatatgaatataaactgggaattaatgataccaaagcacttttaattttgctaggcatgataatggccattatgattatgtaagaaaatgtcctttttttttttcaaagatgcttattgaagtatgtaaggatgaaatgacaatatatggaatttactttaaaatattttggtaagaaaaagggtgattaatgaaatcaaatgtgatgacattttgaaaactgcaaaatctgagtaacaggagttcactatcctattttccctacttctgcgtatatttgaaatttttatcataaaattaccaaacagaatgaaaattcacattctttccactgtaactacagttttcaaacttgagtgtgtctaagaatccacatctcatgcaaatcctaagaatcatcccaaaaaattgtgattttgtttgtctacgcaagatcccagattccatttttaacaagtgcctcaagtgaatctgatacaatctacagcctcatatctgaaaactatacacttaattgctttactacaagtaaaccaaaccttaaaggaaagtcatgatcatatctcttacctgcccttcaccataccccactcctatcttagtgtgatagacatttaattaatccttttcctgacactataaattccatgaaagtgggacatgtttgtttttactcaccatggtgttccattgcatagcagaattcctagcacacagtacacaccaaataaacatttgtcaaatgaatgaatgaataacagaaaagagaaaaaggaaagttaattgcagtccactgtttcaaaattagtttgagggctgggtgctgtggctcacgcctgtaatccttacactttgggaagctgaggccaatggctcacttgagaccagcctgggcaacatggcaaaaccccatctctaccaaaaaaaatacaaaaattagccaggcatggtggcgcttgcctgtagtcccagttactcaagaggctgaggcagaagaatggcttcagctcgggaagtggaggcttcagtgagctgagatcatgccaccacacttcagcctgggtgacagggccagaccctgtctcaaaaaaaaaaaaagtagttcaagacaacaatctgagaaaattttcaatttcttgccaaaaatctggtatcagaagtatggatcaattaagaggggcacaggttggcctacccttaatataacacaagtataagataaactctcacctccctgagatatcagactttggacgttaatttgaacatctaccttcctattaattgtttaggaactgtaataaaaatacactctatatttcataatcccaaacagagagggcaagtatactagagaagaaaatcatatctttacattttaatagatatacaaataaaaaattacacttcctatgttcagaaagtacaaacccctacaattatgaacgtaagtcacaaattcaaaaaataatggcaaatataactattgaaattaatttaggaactagttccaaaaaaagcacttactaaagatggttgacagtcttacatttctaccccaacatcatttaactgtttaagttttatttcttaaataataaatcaaagacaattttttgaagttttaattgaagtgtaataaacaaagtctcatagattttgtttaataaattttattttattattttttttttttgagacagagtctcactttgacaaccaggctagagtgccgtggcaccaacatggctcactgcagcctcaatctcctgggctcaagcgatcttcctacctcaacctcccaagtagctgagactacacccaggtaatatttttattttttttgtagagccgaggtccctctctgttgcccaggccggtctcaaactcctgggctcaagggatacttgcaccttggcctccaaaagtgctgggattacagaccaccatgccaggcctatcatagaattttcagagacacaagagacatcagcaactatctggtccaactctttgttctacaaatagggaaactgaagcctagatgagaaaaatgatgtacttcattacacagagatttaatagcaaaacaagactatgctctgaattttcagtccagtgttcttttcacaccacactaatggcatatttttaagaatactttccattgtgaattgcagtactacctgttcatcttcttgaacacatgtgtgtcgtatccaacagctatactgtggacttaaactaaatggatataccccctttttagtggggatgaggaatggagaagtagagctattggattatcttcagcaatagaactctatatataatatttcctgataagtgggtttttctatcaattatcgtaatagaatctgtagttttcaccatatatccataacaccaaaacttataatcgtgaagcaaaactggtgtaaagttatgcaaagtctaatctaaaactgagaatttactctttattcaacataaaattttatatgtagttccttcttctggattaaaaacatttctgggcagggtgcggcgctcatgcctgtaatcccagcactgtgggaggctgaggcgggcggatcacgaggccaggagatcgagaccatcctggctaacacggtgaaaccctgtctctactaaaaatacaaaaaattagccgggtgcggtggcgggcgcctgtagtcccagctactcaggaggctgaggcaggagaatggcgtgaacccaggaggtggagcttgcagtaagccaagatagcgccacggcacttcggactgggcggaaaaaaaacatttctgactcaaaagattaatgaattaaccaattcatatctcagccgttactctgagccacgtctctacacacccacagggtgcctgtagtgcaagagggcctatttacagaacacacactgaaagtataaaagatacacacagaaagagaacaagataacaactcaatctccataaattagttcccaattgccttttatatccaactaaacccttggcacaaagtatataccatattataaatcacaactaaacaaataaacagtctctaaaagatcttccccatttattgaatctattaataaatgtctcaattttcagttacaattggcttagacgtcaataacgcacagctagattatgaatttatgagcggcttgaggtgccagataaattactctgtacttagagacgacaataaatatcaacttctagactaagcacactgactagtatataacagaaatattataaatatgacaatattacaaatgcttactaaataccaaatgctatgatagttgctttgactatattattcaattcttacaacaatctagtacttttatcccctcttatttttctgaagatgaaacagcattgagaggttaaaataactccctaaaatatttcagcaaatacatgtcagagcctagatttcaatccaagtttaggccctatacaaagatttgctgaatgaataaaaatgaattaggagagtaacttgtttttttaaaagaagttcctgcaacatactaacatccaaaaaagtctggtccaaactaaccagatatgcaattgatactaataacacctattaactcacaaactaggaacactggcagagatacaactttaaggctcaaagatttaatgacctcaggtcttttcattccaagagtaatatacccccaaaacagatcaattcaactggcaaggcatacaggggattagacagcaataatccagattcgaaaatgctacccaaaatctgctgtaataacccaatgtgtggactaacactgtcaaaaaagttcacaacaaaaatttcagtttagcgacagggacaatagtggaattaatgacaaaacagataagtttatgggaggaagcttgttttggaatatgagggatttgagactaacatgacatccaagtagaaatgcttacaaggcagtcagatatttaaggtttgaaacaaaagactaaaaataaagatttgggtatcatgtacatagagataataataattgaagctgtaagaatggatgaattcttcaagagagtgaagacaaagataagtatgataggccaaagattgaggaaaagaaaaaaagaagaatgaaaagatgggaaagcactaggtcaagagagcccaggaagataatttaaaggaagaaaaactcaaagactaacaccagaaatttcatttacatttatcttccacattctgaaaaactccctaataagaaatagtagtgacaaacagcacagtgttagaactcaacaggcactatttgactaatactggttcccttctgtctcctccgctcacccgttgctacacctccaccagccagaagagaagtggaaaggtcatgttcttaacaggcatcatgaagcgatgtgccaataaatatgctacaagcaagatattttcatgaaaagtatgtcaaacttcaaaacaaatgtatctataaccctcccaaccatttttgtttttccttttttttgagacaagttctcactgtgtcgtccaggctggagtgcagtggcacaatctcggctcactgcaacctccccgtcctaggctcaagcaattctctggcctcagccctccaggagcgagccactgcacccggccttgtttttcctatttaatttacaaatcataagcattttttcctctgcaaagattaaatagacttaactaaactccatcccttattctgttttcaaaggtactcaaaatcactgagaaattattacaggccctagacaaaataattagaagataaggaagtccggaaaagagaaatagctcccgataatccttataaactgtaacatggacagtaagaaagacaaccattaggacactggaaagaatctgacctacagaaaaccaaagttgactaatttgaatgctctaggaaacaagtgaatggttatcataatgtatcttagtatttgcagactattttagcatttatacatgatatgaagattgaacttacttagttcttgaaaaaaattacaggtgttcgagaaaagattggatagccacttatcagagttcttccagctacattattctaaactactgcaggttgagtatcccttgtttaaaatgcttggaactagaagtgtttcagactgcagactttttcagattttaaaatatttgcatatacataagataccctggggatggggaccaagtctaaataagaaattcatttacgtctcatacataccttatacacaacaacctgaaggttattttttgcaatattttaataattttgtgcatgaaacaaagttctgactgcattttgactgcaacccatctcacaaggtcaggtggattttccacttatggcgtcatgtcagcactcaaaaagtttcagattttgagcacttcaaatttcagattacggatgctattcatcattagtgtctcaacaaaaaagctgtttagtaggtaaggtagtttaaaaggacatacaccagcaaatttctgaaaccaaaagatttggaagtttccatttctaagcatgaatctagtaaaggaggtagagaagaaacaatttgaaaaccttatttttgggattacaaaaacaactctagaactaaaggactgcacgtggcacataatacacactaataagtaagtatcagttacacaaatcaacaaaagtcaaaataacagaaaaaggcaaccaatgtaaaaggagttttgttcctataatacatgagaggtccaaagtccagatagggaagaacaagaacagactcactgaaaaagctgaagtcacctgataggtcaccctgaatgacacaatgaatgaatgaacgaacgaatgctcaatgttaaacataaaacatcatgcgaagaaaattcatgctagatactacaaacccagaaaaaggattttttgtctctaaaggaaattcagtcttgggccaggcacggtggctcacgcctgtaatcccagtacttcgggaggccaaggcaggcggattccttggggtaaggagtacaagaccagcctggccaacatggtgaaaccccatctctactaaaactacaaaaattagccaggcgtggtagtgcacgcgtgtaatcccaactactcgtgggggctgaggcaggagaatcactcgaacccaggagtcggaggttgcagtgagccaagatcgcgccactgcactccagcctgggcaacagagtgagattccatctcagaaaaaaaaaaaggaaaattcagtctttaccaagttcagattgacggggtaataaaatttcagtaacagctatcaataaacagctgtggaactaaacagaaaaagaggacaagattataagatttgaaggggaaaaaacaaccaaatctgtctgttgactattctctttaacaaaatgttgttttagaagtgttgggctccatgatacctggctgtcctaactctggaggccttgatggcttacctcctccactcttcctctttgttcaaccttcatctttcaccctcatttttccctccattgtttctccctttaccattatatcaacttgcacctttgtgcaaatgacttctaaatcattatctgtaattatgagctcagttctgtatctccaacagtctacaggtcattttctcatgattgctccactatcccctcaaacacaacgaatctaaaattgaatttatctgtaggcctattcttcacaagcaatttccaaacctgactttgctatttttaccattctccctataatccaggctcaacctctttagagtcatctgactattgcctctctctttggttccccatcttttccctgccaataaagttccattaattcttcttttctcattctcatgccccaattttgggcttcaatcatttctggactattacaataataacaattttaaaaaactgtccaatctcactgtctctccaatcttttcccatgctaacccatcttccacacaccagattcatcttcttcattcatcctagcacggtcttatttataaatatttaatagccacaacagtgtaaaggcaatccaaaatccttagcctaccaatcaaatcctccacaatctaacgctaatatttccttccaaccttatcttccttgtttccccaaacatgtcatagccagtcatgtctccaccctctattcacgttatcctccactcctcttgagtaccctctacctaaatcctatccatccattataaaacatactttggctctctcaactcacagtgacttctttctctcaatttccaagaacatacattatctaaacaatcatctggaatttatcacattttctcaatctgtgaagtgtttagctttgtttctgtgtatatatgtgagacaaggttttgtcttccattaaatagattggactctcagggaaagagtcatgacttatatttccttgtatcctccacatgtaaataaaggtccccaccaaatgaagctatagcaagaggccagaagatgatttaaagaaaaagaaagctactaaaccctccctataacaccactcatgtaataaggagatcgaaaagcaaaataaaatcaaaaatatatgaaaactggataaatattaaaagataaatcagacttcttagaagttatagaaatccttactacaagatatattctaattccttccacttatctcgtttaataaaatgttttaaaatctattacgcatcaaccttctttactatctctcaatataaagagcatccataatgtggtgagacatttcaaacaacccacaatagtcttatttcctggtcagggatgcttacaacaattctgaaagctttgggaagcttgttgtaaaacccatacacgtggaaaaatacaaataaacagaaatttagagtaactgaaatgcacgttaattttaaacaatctacattaattttcctttgattcaagatgcgatttttgaattgtattatttctttgaatggtattattttgtttccttaatcttaatccccaaaattgagcatatctaacattatttcaccgaagacattgtgaaatcctgtccatatacatgctccctgaaaccttattttagagattatgtggttttgtttggaccaagaaatattatataacccttagttgttcagaaactctgaacaactttgatacatttacagaggaaatgtatcaaacctaagaattccaattatttacagataactgtattatcaaccacttaactatttttaaaatgggattgtggtttttcatgtcataaaaccctctttagaatgttttacaagtgacaatgttaagtgccacaccaccaaaaagacagttacaataactgtatggtacgtacttttgtaaccaataatacaataaaataagttaacactgtaattacctatgaccaattatcttggttttttacaatagtttagcaaaaagttccttcaaactcaaatcacctatgaaattttggctcaaaaatcacttcctcaatagcaattctccgttatcattttcaaggctaaaaactaaacccctaggagctaaatcgcaaaaaggaaaaaaaatgcaaagtagtctttccaatttaactgtcaaacggatcagaaagattaacattaattactacgatcgccattcaacaaactgtatacattgcagtaactctgacgtgataactttttataggatgcctgcaatagcagtttgtaagtatctttcgggtactcatgaactgagtcagaattaaaagttcagagtagttagtacagagccagtcaaatggcaaataggaccacaccatgagatgttaatggtactccaagattcttcaggaaacagaaatctagcattttccaagacgattatgcacacctgagacttttgcagcgaaccagactaatgcaagaggaaggaaagacatgcaaaaccccagacaagcaaaagagaacagcgctactcaccagcaaacaatccgaattcacttccgatttgggatcccgcagcaggttgtccattttttcaaatcgagtctcaaaactgtccccagtcgacatgttgctgctgctgtgacaatgccctcttaccagcaccagcagcggaaagcaatttcaaccaacttcctccgcggtgggttcgcagccgcggggcggaggagccggaacctcagggtcaccaggtgcgcccggttcccccgtcttcccctcactgaggggacctccgctctccagaccccgggccgggggcaacagcgacccacagccgctcggacgcccaaagtcgcatcccacccggcagcccctcacgacagccgacagcgccgtcgccaccagcctcgtcgctccggcgaggtgcttcagtctagcgggccccggccgccgtcgccatggaggggtccccgtcccgagatgggcaggagcgggtagagaaagagaagcagggtggagactccctccgggcaacaagggagggagaagaggaaaggcgaaagcaaagggcgggtgaggagctgtgccagctgcggccgccgctcgggccacgggccgggcccgctccgctcagaggcgctgtagacggtctagccccgcgtccccggctctactcggcccggcccgacgcaccgatcagtctcggccacgagctggtccacgcaggacagcctcactctcccattttgtcccgtcgctgctggggctgctgctacggtgtccggtggggcagggcgaggtcgatgcccgatggagacttagcagaggaaaggctggagagcgggcgaagaggaagacgatagttgggtcccggcggctgctgatgggggagcttctgggaggggctgcggtcccagccggggaaagggcgagtcgcggcggcgaatgcctggggggtggggcgaggggggctgagagggactaatatgtccgccttcctgttcaaacaaacggagaccgccggggcagactgcgcatgcggggcgcggacgctcggaaggggaaccagc

SEQ ID NO: 961 - DNA, 100149 bp, Homo sapiens
tagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaaggtagatactaaatactgaaactaataccagtcattctattccatcttctgtggtaggcttcactttcataagggtgtgggggagatacctaacgatgttttcacccctagtgaaattaattgataatttcctatggtgctttgtggctatatttcaaatgcagtattttcttactggctcagtaggaagaggcttggagttagatgatttgggtttaatctttgccctgtaataactataagactcttggaaaagatacttaatgggttagtgtcttagtctgtgctgctacaacaaaatactgagactgggtaatttataaatgacagaaatttattgctcacaattctgtaagctgagagttcagcatcaaggcaccagaagattcactgtctggtgagggcctgttcctcatgcatggcaccttctatgcatcctcacgtgacagaaggggcaacacaagctctctgaagcctcttttgtaaggatatttatcctgtttattagggtagagccctccatcacctcccaaaagccccacttcttaataccattcacctttggtgttacatgaattttagggagaagcaaacattcacaccacagcaataagttaaatcattttgtatttttataggtacaaacaaattactggaacagagaaaagtgctaataatgagacccacttgtgtatgggaacttgggatataattgtggttgtgctatagtcaataaaatagagtggccaggcatagtggctcacgcctgtaattccagcactttgggaaggcaaggtgggtggatcatttgagcccaagtgttcgacagcaacccgggcaacatagagaaaccctgtctgtacaaaaaatacaaaaaagtaaccaggtgtggtggtgcatgcctgtagtcccagctaccagggagacttgaggtgtgggaatcacctgagactgtgaggtcaaggctgcagtgcgttgtgatcacacctccagcctggacaacagactgagaccctttctcaaaaaaaaaaaaaaaaaaaagaaagaaagaaaatagagtggaggggaggggacatttcaataaaggtgcaaggatggtaggctttccatataaaaaattaggttttttttaatctcatcatatggagaaatgaagtccagatatgttaaagacctagatgtgtaatcaaattttaagtgtactagtagaactgattttctgatgtctgtataaccttagtatggaaaaatatttcttagaacctgagaaatacaactctgaaaggaaatgactcagctttattccctctaagcaaagaattcctgcagggggaaaatgatactataaactgagacaaaagacaattcacatctgggaaaatagttttataatatatgtaagacataaaaggttattatccatagtatatacaaactcatacaaatcagtaagcaaaagacaaagcacccaatagaaaagaaatgcaaagtttaatgacattaatggccaataaatgtatacaaaaaagctcatactcattcttaggtcacatgatccatactaataggataatttaaatcagcaaaaccagatagtgtctcacacttaaaagtgcaagatccaaaagtctggtgtgtaccaagtgctggttaggataggggaaaaagggatgttcacacactgtttgttcccagaaaaactcctgcacttgtgtaagatgtgtgtatgagaatatatactccaacattattgggaacaaatttctgtttttctctttttatttttaatttttgcggatacataataggtatgtatatttatgggttatatgagatgttttcatacaggcatgtaatacttaataatcacatcatggaaaatggtatattcatccactcaagcatttattctttgtgttacaaataatccaattatactcttagttattttggaagtgaatttctatcattaggaaatgtgtgagagaactctgatatattaataaagtagaatattcaactgcacataattttaactaaatctctacatattaacatgatatatgtattgaaaatacaatattaaggaaaagaagatcaagtttcagaattaaagcagtttcaaagcagtggaattttaaggacacataaagccacaatatattgttcagagaaatgtgtatagtatagtaaaaaaaacataaatcagatttatgaatgtctagctctgggaaggaagagagaggtagcaaggaattatattctttatctctaaggttgtactttttatataaaaaaccaggaagcagaatgataaaatattaacatttattaataaaggggtgttgtgaacatggttatgttacattaatcaactttttggtatttctttgatttttggcaaataagtgctgcaaagatctgaatgtttgtttcctcccaaaattcatgtgttgaaactcagccatcaatgcaatagtgttaagagatgaggcgggcctttgggaggtgatataggtcatgaaagctaatttctttcattgccttttaaaatgaattctagatatgtcacaaaggtagaaatgatcttctccattagaggagtataattcagattgcattcctcaattacccttccaagtataaataatgcatttgttttctctgccaggctggcattagtcttgatttgtaacttttcctatttacaaagccaaagattgctatttctataaatgccttaccttcttttgtgaccttgttttttggtgattgtcaggttgacccttttcctcccacatcaagaaagttttgtggttagaagaaagggagggcaaccatcaggcaacagacttcctttgatgtcatattcaagtactgatcttaagctgtcctttgggtttttacaaagatactctaatgcatggcttccatctgatcccttcctccagctgtcttcagcctttgctttaatgtattttgattattgtatgccctatctttatgttagtaatcatgcttaatcatttcaaatagactttttaaaagttgaattaaaccaataattggtgcaatagctttctttttgtgtttattcaaaagaattttataaggttatctcttccctgtcttatgtgaaaggctggcagacattttctgtaaaaggccagacagtacatattttaggttttgtaggccaagaggcaaaatgaagaatattatgtaggtacttgtaatacaagagaaaagacaaatttccacatattttattgagaaaattgaaaatataatagtattagtaataataaagtatcttgaaatttgtaatatagatttactaatgtaaataatagaattatttcttttgagataatgttttgcttgcctggggttgaacattaatgtttcctgtcatcagtgttaattgtaaatattcatctgtcgtactgatctgtgttgaaatgttacatatttcatatttaaaacatcttttcacacatacaggttttgccgaatatagatattagtctactagcatgtatgcacattcataatttggacgttttttatacgattctttagattcatctcttgatatttgccttttagaatttcattacagtgcagaatacttccaattgaaaattaggtggaagctcctcagttgcacagtcaaatggattttttaaaaattccttattgaaatatgtttcacatatcgtatagttcacatatttaaagtgtataattattattttgtatattcacaggatatgagaccagtatcactacctaattttgaaactttttttattccccctaagagaaatcccatacccattattcatcattccctgccctcaccccaggcctcctatccccatcctaagaaaccatgaatctagtttctgtttctatagaattgcttttcctggacattttatataaacagaatcatgcaatatgtggtcttttgtaactgacaaatggattttgaaataaggaaatttcaaggtccaaaaaatgctgttggaatgttgaaatcataaattgagctcagaaaatgtgtctactgcaaattagtgtgaaaacggagatcttgcttcttgtttttttaaatgattatttgcttatttttagagacagagtctggctatgttgtccaggctggctttgaactgctaggctcaagtgatcctcctgcctcaacccgtggaatagctgggactataccttgcctggctcttattttaatttttgacaggatgagaaggtgatatagaagctcaacacttgaatcttgtgattcaaatattagttgttacaatgattttactgcaatattaacttgtacattctgcggtttgttgtgattttagattggattaattaacatacattagaaagtctgcagcaaaagctaatttccaaagccgttagattaagtgtccccaatccagggatcaatccccggactgttaggaaccaggccacataggaggagataatgctcgggtgagcgagcattaccacctgagctccgcctcctatcaggtcagcgaaggcatcagattctcatgggagtgttaactgtattgtgaactgcacatgcgagggatctgggttgcacgctccttatgagaatctaatgcctgatgatctgaaatggaacagtttcatcccaaaactatcacccctgacccccatccatggaagagttgtcttccatgataccagtccctagtgccaaaaaggttggggaccactgcattaaatggtctatggcagtttttcgtattctgaaaagtttcaacctaagctcaaaatactgcaataaaactttacgactgctaactcatcaaattactggctaaggcacatcaggatattcagcttctactcatgacagaattcacagaatgattgttaaatccatgaaagcaaatgaattttataagtgacactgttggttcaataacacatgatagatttgagtatttttcacaaagtacctgctgataagtaatacagtgaataaccacaaccgttaaaaacccaaaatgttcactagctttttaaatttgtcaaactaagcctttttctatcctacatttttgccaccatccattttaacacattttagcagattctacttgagattgtactgaatttgtgttttctcaatttgtttaatctttaaacttctctaattaaagttctttaatcgttaacacctttaatctttgcctatagttattccacagagaatgttcattcatagagactgattttccaggtcacttcaaactcagcattgactcctcaaataaacaataacagttaagccgtatctgtatgtcagttgacatgtaaagagccaaggaaaacaacttgaaatcatttgccttgtttttaaattgcatgttaatgttgcttccaagttttgcagctctttgaacaggggtatcaccaaaatgctaatagtcttaaaccagtttatttttttataagcatatatctgctacaatataatttaatttgcttgtctaacaaatgtgccatttgaaaagttactttggtgcagcttcattttgcatgtttacattttgtgaagttctgtgtgatggaatttttttttaatttactattttttaaaccgtcactttacttttagttggcaatattttgatgagcgcttatgctagtaatgttgtcatgtattgtattcttttagtataactacagtctcactgcataataaacaaagttatttgccatgtaattacgtagcaaaataatccacactccattgtgccttcaaagcatgacacttgaagtttatttatcttctttcttcttttgacgtatgcaatagtaatgagaaaagtaatgcaagagtcatggtaaggtaatatgcatggcactccaaatgctgtcaagttttaactgtcactgtgattcatagtgaactgagcaatggtgggaatcaatgagaatgtcacctatgatctccatcacaactcagctctgccattgtcacacaaaagcagccataaacagtgcataaatgatgagcatggctatgttccaataaagctttatttgtaaacacttaaatttgatataattttcatgttatcaattattactattcttttcatttttctatttaaccatttagaaaggtagaaatcattcacaggtcgtaggctgtaccaaacaggcagcaggttagatgtggcccatggaccaaataatttactgaactctgtcctatattattgatttttctctttattggatctttcttcttagcatacaaaccagctgttattgttctctgcttgaaaaaaaaaacaccaacaaaataaagacaacaaaaccccccttgtagggctccatttttccttgcagctagtgttcctcttgtgtgctttctttataatgttttgcaaaagttgtctccactcccatctcttatttcctttctttccattttctcttgaacccatttcaatcaagctttgcctctacctctccactgtaactgcttttgtaagtatctgacacaatttatcactctatcctccttgaaatactttcttcacttgacttcaaggacaccatagtcttcattttcttcattccacactggatatttattttatgatttgttgttaattaatctccttctgaattacttcttaacttttgttttaactcttataagtcttggtccttttatcttctctatgtatgctcactactcttattatcttatccaatttctggtaagtattctgtatctgccactggctttctaatttatatcccgagctcagacagtttcatggaactccagacttgtttatacatctatgtaatatatctgcaattgattttataagagatatctcaaatttgacatctcaaaaactcagttcttttatatttccctgtaaacctgttttatttatagttttcaccatttcagttgatggccattccatttttccagttgcttagaccagaactttggaataaactctgactcttctttctgtcatagcacattcttatttttcatgtgtgattgttagatctacctttaaaatataaccagaattgagccacttctcaccatttcccctgctaccactgtgaaccatgccaccatcattctcaccaggaatctagcagtaaaatcttaactattctccctgccctagtacctttgtagagtgatctcaagagtgaagccaaattgggcatggtggcttacgtccgtaatcccagcactttgagaggctgaggtgggaggattacttgaggccaggagttcgagaccagcctgagcaacaaagcaagaccccatctctacaaaaataaaaataaataattagctgggcacagtagctcattcctgtagtcctagctacccgagagggaggtgggaagatcacatgaccccaggattttgaggttgcagtgagccaagatcacaccactgcaaagcctgggtgacacagtgaagccagagagatcatttaaaaatgtaagacctgacatgttgctcttttacaatgtctcctcagagtaaaggccaaagatcttgcagtggcctgcaattccctgtgtgatccatgactctgttcccccaccctgtttcctttctgacctctctgactccattttctattcctcctgccattgctcactcagaaccagcttctcggactctttgctctttctcacatcaaacccatgtctgcattaggacctttccagtagctgttcatctttcccataatatttacatggctagctcttaatctgtttccagtctgtgctcaaatatcaatttctcctagtggccttcttttagcaacccatgtatacatgctaccaaccctcatcccccccataccagcattcttcttccttgtttaatctgctgtattttttcatggctttattatcttctaataatgatgtgttttatttattatattcatttttgttgtctttttctccccgcaaggctgtaggccatgaggataagaattttgtttggttttgttgattcatgaggcctgagtgcttgacatgtagtaggtgatcaacagacatttgttttaaatagtatcttgaagacaattttgtaaatcattttttctatatctagaattgtaagattttagagctggaagggattttatgttataaatagtttctaaacctgtgctaatagccacatggtactattcaaatgtaaattaaaattaagtaaagatttagttcctcagtcctagtagcaacttttaagggctcttgtgttcagtggctgctgtatttgaccactcaggtatagcacttttctgtcataccagaaagctctattagacagccctgggcccatggattccccaaggtcatacaggtcattagtccatgactgatattgaacccaggggactcaaatgatttatgaaaattacagagtattccttctcatataaatgccctggggatcttgttaacattgcaaattctgatttactaagcctgagatggggcctatacttttacaattcaaacaagctacaaagtaatgccagtaatgctgacctgcagcatcacactttgagtagcaaggctgtagaatgctctaaaatattaaggaataactccttttaacattttaagtaggacatgtattcatttttaccgcaaaggtatgttttgtaattagaataatgtttcctaataaaactaggtgaaaccttaaatactggttttgtacaaagctacatatattaaaacatgttttctattcccaaatgaaaacttgataaataatagtcaagcaggagaaaataagaaactaagaggctatagaacattgattttaagaatgtacttgacataggctggtttgtggtttatatttctaatgctgtgtagatgtaatggctgttctgctaacatctatagcaagatactggattcggttagcttgttctagtgtattatataataaaagtttagaatagtgagaagaggggaggtttttcttgttgaaattgacttgttccattttgtttcagaatgtggatttgatcttggaaagtatggtactatcttttgaatgataaaagtacattgaatttttctgttccaaattttgtaaagaataattctttagcagaacattctttgttgtaatgattttttttgtcaaattctaattgtaaagtaattggattactttaataaattactagttagtaaatgtaataaatttactttaaataaatttaataaatttatccttagttgcttatgcagatgaccactcatcttttacctaaaacgatttatgtctttgatgatgttacatttagatatcagaaaaagacattgccatgaagctgtctaaattttccaatgtaatagaatatttgttcattttatagactgagaaacaactgtcagtgctcttgcctatagtagtattattggcaaatttatagagcataatcaaataaaacattttgtaataattgagttcaaatagtaaaatatacttgatatatgaactttcttttggtctctactgctggccagttatgcctaaagttgacttactatcagaaacgcatgaggcatctattaaaaaatagattcctgaggtcttgccccaagaaattctgatttagtaattctgggatgtgtcccaggaatctgtatttttacaagtatcttgggttttctgactaagcgaacaatataaatagagtgcctagaacaataactggcagatagtaattacaagtaaatattagatcttctcctcccctcccgtcctttccactaaaattattatcattagcccatctgttaaccaaactttggttaggttttcctttctttgatgaagaggcttaggaaatatgagagaataagatcattcctcagttgcgcaaatattcactgagggctttctagttgtggcacgcactattccagatcttggcagtgcaaaggtgaacctgacatgtttttaagtcagggaattgtagcctattcgggtagatatataagtaaaatcacctgtcttacagtgtagtaggtgctacattagagctaggtgcaggtgctgggcggcacataggaaggccgggtaggccagctgtttgtcagggagagttttgtaaggaatagtgaggcctcagatgagatctaagggtaagtaggagttagccagataaagaaggggctgcgtaaagagtgtgtcagggctaagagtgccacagctgaaagagcatacttcttcagtgaattgcagtggctcagtagaagcaggagatcctctggagaggtgagtgggaattcgagccattaatctatgacaaggaattgaggcctttattctgcaggtagtgggcagtgattgaaagtcattgaaacaacattttgcatttgagaaaacaaattactctggctggagtgtggagaagggactggaaagagggaaggggtcatgatggaaggaagaggaaaaagcaagtttagaagaaaatggaattttaaaatattagcctagagaaaaaaaaatatgtatataagggatgtgtgtgtatctttttgttttataaatgtttaaacatatttttaaaatataggcagaatagtctaaccccatgtgcctgtcacacaaccacaacaattagtgacttatgaactattttgttgcgtatctattcccactcacttccccttcccttccttattttgaagcaaaatcctgacgtgatttcatctgcaagtctttcagtatgtatctccctaaagtgaggacttattcttttgaacggagacataattacacctaaataataatcatttcttaatatcattatatatctagtcagtgttcaaatttccagttgcctcatgaatggtagacttcacaaacttgtaagtgaaataactaagactgtccagacttctgacttcagatgtgtgaatctgttttctcccatacacagctgctttgctgctcccaaattggagaaaaaaaagttagttactagcatgatgttaggtagatacaaaagtttctacaacctgctttttgtatatatcctcaaactactacatcctgagctgcccaagtgttttcttttgtgctagtaagtgctactttaggcagttgtatggcattatatttccaactatgctttcatcttttttaggagtaagaattatacttgaaaaactgtacacctgttacttgagcctgaattttatagctccgtggctgactgttggcaggctctgggatttggagcttaccatctaaaagagatagtactgagaaagttgaggtatactacgagaattttttatgatccaggaatagacaactttgtaaattcaggctactaatattgtgtaaaaatgggatgttacgtatccaagtattaacctaaggataatttatagttctattaagaaaaattaaaacaagattatttctcattgttgactatatttgtacccttgagtagggagatgtttgtggtttgtcagttatttataccaccaccttcttcatccatattttattaaaagttagtgtacttttattgcctctaatctcttttacagattttattttgtgaaatattatacatacaaaagaatataacacatggttatagttttaaaaacaataataaaatgaaagctcacataaaaaatagaacagtaacaatattgaaggccatcctggtgccatccaaaacacactgtgcactctgattcagagctaaacaatgtcctggattttattgaattatttattaatttagtttcattacaaatgtatgcatccctaaacactgttgcttagttgtgcacatttttaatcacttttataaaaatgaaaacattctttgtatgttttttataggacttttactttattcaaagttaacattttgagattcttttatatgagacagcaatttgttcatttttcattgttgttttggagtttgttgtatgaatataacccgatttacttacactttgcctattgaaaaacatttggagggcgggtgctgtggctcatgcctgtaatcccagcactttgggaggtcgaggtgggtggatcacctgaggtcaggagttcgagaccagcctgaccaacatggcaaaaccccatctctactaaaattacaaaaattagctgggcgtggtgatggacttctgtaatcccagctactcgggaagctgagctaggagaatcatgtgaacccaggaggtggaggttgcagtgagccgagatcgtgtcattgcactccagcctgggtgatgagcaagactcttgtctcaaaaaagaaaaagaatcaagaaaagaaaaacatttggaatatttctgggttttttttttctatttctcttacagactatgtacatgtataggaatttttccagattttttaaatctgggaaaggttttgttgcttcacaaggccatgaatctttaacctggcttggtattgccaaattgttttccaaagtggttgtgccagttgatactcgctccacagctgatgaaagttcccattgctccataacctcaacagtacttcatcgtatatttaagtgttttgccagtctgcagggtatgaataaacatctcatgattttgtgtgttcattaccctcatttataattagcttgagctttttttatttttgaagatttttaattttgaagatttttttaatttttgaagataatttatgttttctctgatgtgctttttcttatctttagcccatttttctgtttcttgggttgtctcttactgattgataggagttctattttttataccctcaatactaatcttttgttagttaaatgtgtgttgtggatatcttctaccaattcatggttttctttttctatttttatgatgtcttttatgaagagttttaattatctttaatccattgcaatctgaattctgtccccacagctctgttgacattggctcttgaaggcaaacttcataatgaggggaagagtcaagttttgtgtaacctgaagcatatacagtgtgagcatactctttaagactaagttatgaatataaagttagatgcaaaagtaaatgattacaatgagactataagtcacaacaattacaaattttaaaagctaccaaatactacaaatattgcagttttaaaatataacattcctcttaactgccttgtatatctttatattacttatctattttttactatataaagcctgattacctttgtataatgaaaattttgtaatgtaattttgaaagttggagtataaaaatgatccgtattttctttaaatcatcttaatatggtttagtattgacagtggagatgcataaaatatgttcctcttcacacagacttgtttgtagcactcctgcaagtttaggttctacaaacacggacgtgctggtagagtctattttttcatcatttctgtcaaaaaagaatttattttctgttttggtccggtgtgtattcatttgttaaactgatgagaagagaatttctgttttgaccaggcatagaaaagagaatcctctgtttaaaatgttctgtgtgatgattgaaaggatttttctatagaagagttcacggctccatgtatttgcatgtatggctgcttcactactcgcatgttccccaccctgagctttatagaacatgttgtattacaatcctggtgcttaagtcatgactccaggtaagtcagcacaaaaggatggaagatattcctggaaatcattcctaccctagggctctgccaattacttaaccatatgcgaaagtgactgtaaatcacatagacaggttcacacaactcgagttaatatattcccatctcaaatacttcttaggcaaatccgaaaaatgttcactcatagctgtagtaatgacagcagacacattgatgaagggcaagtcagagtggaaagtgacaggggtcttaaccaattacagttaaatctctcactcctgcaaaaacatctgacgcattgagcacattcataggtccttggaaacagcctgtggcgatgagatacctggacactagtttcagggtaaatcctgcatctttaatctgctcgctctctctacagccctgaacactttcccttgcttgttttctttactttctcacctttagttgtctctccctcaaaggcttttctagactctactaacttaatgtatttctccaatatctgccttgcttttaattttttcatcctgtagtatccctttgaccttactgatcccaccgcttgaactgtccttacctgttcttatgtgacggtgactccaaaatttccatgttgaatcctgaatgtctgcctgactccggcattccttttctgattgtgagcaaggggcatctcctaattgacatggctcctcagatgcctcagattatatatgttcagagcaaacttttaatatttcttccagaccattcaccacttcatcctttcatgttccagtcatttctattctcagctctgggcattttcattctcccagtcacgtagcctcaaatcttcatcatctccgttaccttattttttcacactttacttccctcattttgcccctctattctcctatcccatggattcaccttgtatgtcatttacatttgccttttttcttccctcagctcctttcccccatttcagattctctaacagaggtacaaactgctgtgggatatggacaaggggaagtgaagacgaattcaacttttcctaaagcctcatgtaaatctgtctgcttatctccatcttcactttgtccatgatcccaaaattcagaatttctctaccatttttctatatacatttttttaatattggtcataacatttaaaaactgtgtagaaggccaggtgccgtggctcaaacctgtagtcgcaacactttgggaggccaaggtgggcggatcatgaggtcaggagatcaagaccatcctggccaacatgatgaaaccccatctctaactaaaaatacaaaaaacctagtgaagcatggtggcgtgcacctgtagtcccagctactcaggaggcccaggcaggagaatcgtttgaacctgggagggggaggctgcagtgagccatcgcaccactgcactccaacctgggcaacagagcgagactctgtctcaaaaaacaaaaattgtgtagtaatattttgtcaacataagattataagcacctgtatggttgtaaacatgtagtgggcaaggaatctattctcactttggtccagaacaatgccttacatgtaataggccctgaaaaagtacatgtggaattgactccttcaaaagtgccttttgttgccactttttgttttcaaaaatagatacatgtaattatacctttacatatagtatagagcttgcagttgatttatagcagtatttgacataaaacacaacttctttcttaaggtgacttcgtgcctctaaaaagcatactaggaaaaacatactgtgtattatactgaagacaaacaaggcctagtggcccctagtccagttctgagactggctgatctttggtatatttcattttaaatttcctcttgtaggaatgtcattccatttttaatctgcccgtgtcatgagtttctaaccgcaggtgcacaaggaagttggcacttcaagctggcagggattcatttcttccttagctgattccccagcagatcccttctccagtttcactgcatgctttctgtcttgtgaattcctgtaagtgtatctcttctctcatctttcccacttcttttagaaaaagagcaaatacaattgatctttaccttttttttttcaagctttaaaattgtggttcaaactcattgttatgtttagtgtgatcttgtagaaaatgcactgtactttaggctcatagactgtagttctgccagagcctaaagtataactacagtcaagccaggtgatctatctgtgccacatttgcttaatcttgaaagtgagggtgagccttagggctgttctgtggatcaaataaaatgatgaaaactgctttgaaaagcttggagcagaatttttcaacattgagaaatgttcagacaacctttaaaggaaaaaattatcatggacccctggtgttgacttagcattgtaacgttaaaaaaaaatccagttgtacttttcacatactttatacttacttatttctcttatacagataaacagctattaaactattaaataaatatatgaaaaaggtcccagaacaattataccaccaatagcttatttacaaattgacaagatcagtttaatgaacaatattgttgtttttgctgctgtttgctgaaactaaattagtgtaactgagcattgtactgattactgccactggtcttgtaatgattcagttctctcaagctatatctctgtttaagctagagaaaccttggcttatggaatgcagtcccattatttaatatttactttctgaatttacatctctgtttatttttttttagtgcttggcaaatagtattaatagtataaaaccttgccacatcgtaccattattttgaatttaaattggtgttttagtttgtttgcgattctagaaactaaaaatgtattctgttgaatggtattataacatgaattattacttaaaaatttgtcttaaagctgattaaaacaagactcttttactatagtgatagttgctgtatattaggttacactttgagaaacacacataatgttatatgatatgttatatataatacacaatgtgtaaatgtaagggggcattatagatatcagacaatagttgtaaattgttcagccatttttatatgatataatattctataaagaaaaaattattattttttgaaaacaactactgattcatccttaaatatttattattttataatttactagggtaattttgatcctcacattaatcaggtattctaggaaaatatggtacatttcagatttgtatgcatattagagaaatagagaccctagaatatattttatctgaatatattggctgaaatacatgagtatctacatgcctacattttaaggaagttttccatattcctatttcaactaagttcatagtctagcagtgtgccgtattactggaaggggtagtcctaagtggataactgtagtaaaaagatttctttaaaaataaaataagctttactccctagaattcaagcatagcatgcataccacagggattttttattctttcttttatatgtaatgccatggatatttcaaaagtatggaagtatgatgtatgagaaatgtctttcaattacatatagtgaaaacattctaaaatgaccttggaatatagagtctgaaatatccaatcaccagctcaaagattatgttttacttattgatttggcattttgcaaaatattaatttttagattgttctttgatttttctattgattaataccacctactgctgatttatgaggcttttcttacaagggaaataaaagaagtcaagttttttgaagattggagttagttatattagggaatgctgaatttagtatttatgtgaaattctatgtaagttttcttgtatttttaatgtgttttctcttgttaccagtttttgtgtgtttgttctcccttgcccagcccccattcttagaggctatgcttttgaggtcagtagtaaatggagttgtcttctctaaatttgttggacttaattcgagaacggtagaatgaaggaactagtgaagtctggggcacagagaatcccgtattaatgttaccaccagtcttataacatggcagataaagacgtaatgatatgttttgtcaactagtaattaaaatgtgacaattgaaataattaagtaaacttattcctgataattcctagcagtatggcgttttagtgataaaatataaagttaaatttgaatcacagttgttaaaattagggattattgcttactaatccagagttcacacacttgtcttggtctttccctttaagtttgcaattttgaacaaagtataggatttctcccttgtgtgataggaacacattgtaatgaaatccttcatgcatcactgcattgattttgtattatttgtgctgagagagggaaacaaaatgattattttctaatgctgagtggaatgattcaaagcaaagataagtgaaaaaatgcatagcagctggagaacaaatgttactcccatcaattattccctgacagatgagggagtattctcaggcagacctctagaatcactgtttccatctaggcagggtgtactaaaataatttctccacgtgtattttaggtgctgttgtattctccatatgaaataagatctttagttacagatctttttatgagccccaaactcctaatggatggtatgcattgaattattttggtattgttagagagtaaaatactggagagactaataatctccagaatggcttactttgatgagcctagccaggacatctttgtcttgttgttagcttctaaatgaagtgcctttctgtatggtctgttgctactgagtgtgaggaatcttgtgtggctgctgaggaatttagctgccactttccaggcaccggaacaatgtgcccattcgtggattaaggaaaccatgacctcaagcctcctaatcctcctcgtcacaagcttcatggtctttaactggcccaagttacttttaattactgccctacttctgcttccatttctgtatccaaatgctgtcgtgccccctgcacgcccctatccccatcttcccttgagacttagagaattgcttgcttctctatgctttgttttggtttcatttccttatttacttccaacctgaataccttccttgactttcatccccaaagaatttttttaaccttattatctacgaccacagccaccccgttttcctcttcttgcttttaattgtcagtgtcacgctggccccgtatgttcctgtttgaagtcttgctaggtctccctcctcctttctgctttctgatagtgtccgtgtgattttcgtgctggcttatcaaacttcatatcccttatatggaaacttttccccattacattatttttgtaactaagtacttactgtgtattgtggaatctatttggttctattatagctagatgaaggagagactcttgcagactttattaggcagaggaggctacttggtatattgtaatagttctgggtctacagcataaggcaattatatcatgtaaatcagagcaaccaggatgctatggagtcagaaaatcttgttattatcctaataatgaaagtataaaaaattggctgcatattaaaaggactgatttagtaataatagtggtagccaaagattaaatggcctaccttagtaagtagtgaggcccttgtcattttaaacacacacgcacacaaacacacacacacacacatacctattcaccttcagagttgtaagggaggctaaaaatcagatatatgggtgagtagaagagatttaacatttgattttcaacataggatcacaggatttagtgattagcagaatcgagaggctgtatggttgtacaatcactgataagataatgaagtaagcatatcatagtggaaaataacactggctctggagtcagactgatagggattaaaatcccagcactgctggtttttggtatgtgaccttggaaaagttagttaacttccttaagcctcagtgtcttcatgttacaatggtgatacagtaactactacataataaatactcagaaattattagatagcaacatcattatcatcatcgtcatccaaagatgattgtaggaataaactttagagattcactgcacagtatggtgactgtagttaatttatattttaaaattgctgaaagagtagattttaaatattcataaacatataaggtgatggatttgttaattagcttgatttaatcattccacaatatatacctatattaaaatatcacattataccttataaatatgtatatataattatttgtcaattttaaaaatacaggtagttatagcaaaggaaaaacccaatgtgatttttttattgtctttatctattatcagagctcataccataagaagctcatagcttcttatatgctatgtcttgtagtcctcataatcttgttaggtacgtggttttgaaggagaaattgaggttcagatacgttagggaaggcctattatgggaactcagaactaattgatcaacatctgtgtttaagcttgttgtccagtagccaaatgatgtcaagtgctgcaaaaatctgcacctaaaacactttttggattagactttttaattctaatctttctttaaatgaggggttacagtttttttctttaaaattcatccatcaaataaggttgcctttcttagaggcagctttgaaataaaatctaaaaggaaatattagacaaatgttaaattatattaaagaaaacagggcttgccagttatatttccccttttgttgtagggcacacatctaatccttaccctgttactgagttacagtttgattgtgaccacaaaagtaatcacagtcaacaggaatggctggcacaagaacagctggcatcaggtgcaactttctctctcctccatcctagttaagtgccattacttatgcccttacccttggattgtaccagcactgtctagccaagatagttttcctgtggctgatgaatcacatggtaagagggatgagggtggaagttgagggaagataagcagaacagtgaagatcctagccctggggagaataactgtctggcaaattaaagataacgagaatgactttcttccctgcctaggaaattgcctccaaaggtaggtacagaagtgttctaagttgggatagtatcactgggagaagaacaaggcttctagtgaagtgctgtgaaggcctaagtctttttaaatgatcctctgtttcacttgttgttgaaagggaaagttaaaattataaatgcctaaatatatgcacaaaggacaagaaccacagctcgtgtgtaattctggtgtgtttcttagaaagtctcactactttatattaataattacacaaactatacaggttttttcagtagttgacaaaaggaaataaaggcactttctaaaggccttgtcttagtccattttttgctgctataacagaataccacagactgggtaatttataaagaaaagagattgatttggcttatggttctggaggatgggaagtccaagtgtatggtgctggcatctggtgaagacttttgtgctgtgttattccatgatagaagggcaagccagggtgccaggcagaaagggaaagggggcagaactcccaggataacagcattaatctgttcatgagggcataaccctcgtgacctaaacacctcttaaagtcccacctcataatgttgcaatggcaattaaatttcaacatgagcttcagaggggatgttcaaaccataacaggcctgtatgttaggtttataactactatggaaaggactgatgtaaactcagcctcaaacttggcgtctcaggtcagtcagaaaagtgcctaaagcttcttcactctgaaatatcagcatattgagacatcaaaggataaaaaattctgtgcaaaatgttgactctgcaacttaaagacaaatatggcttgcataacataagggtacaaggtgaaactctttaatcatgatgagaaagcagaaagacattgtattttgcaggcaagagaataaacttgatctctgcaggaaagtcatgataaaaacaggtatgtttggattgggttttcagtcatcaactggtcatcactgaagcttcctataacagctctttaaagtttcctttgaaaatcttttgaaagaacttttttcttaaatccatacctttgaaatcttgaaggagcacttaatttttaagaatctttaagatataatgctagaaattcatgtaccatattacattcgaaatatgatttcatgtggttatttattctgttattagataaaactgtatgcaatagaaagctttcaaatatagacttgtttaattaaatatggttttgtatagaacataaggtattagagcatagttaggaattatgggaaattattattatttatactggaaattcaggcttgatttatgtcacactctaagaatagtatttaaaattcagataaaaatcatttatactgtgccagccttgaggaataggtcagaaaaggtgtttgttataagaacttggtaatgggctgttaattaattaaatagtttttgaggcacgctgccaggcccaggaaagtgctttcaaagtctgtactgtttccatagctcctgcaaatgataagaggcttgaggatacttcccaggaactcctgcctttttggaggtgactctgtcagttaaagtgtgaatgaagagtggagcataaaagtagagtatccctttatgttggagatgtttatgttgcaataaatgaagaaaaataagttatgaacttttgactcgagtttccaaaattcacattataactgtgatgcaggagctgagaaatttccattaaaagagttgttcaatgcaggtgattaataatactcaactcctaaccacagggctatagaaaagttaaaattgtttaatctcactttcctagcatagttactattataatattattttacttgtactcattttttctattatgttatatagttacaattattccacagaaatttacagcatgcttttttaaacttagatttatttaacatacattttcaaatttgcttcataaacttcataattaatttcaatgaaagcatactattctgagcaaatatataacaacctaatagtctcctatcagtggacattaaaaattatttctgagttttgatttttactattaaagttgaatgcatgggctgggtgtggtggctcatgcctgtaatcccagcactttgggaggccaaggtgggcggatcacctgaggtcaggagttcaagaccagcctggccaacatggtgaaaccccatctctactaaaaatacaaaaattagccgggtgtggtggtgcgtgcctgtaatcccaactactcgggaggctgaggcaggagaatcacttgaacccaggaggcagaggttgcaatgagccgagatcgcgccattgcgctctagcctgggtgacaagagcaaaactccatctcaaaaaagaaaaaaagaatgcatgatagacatctttgtgtatatagctttgtctgttttttatttgttctgttacagtaattattaagtatgtaaataaagttctagacaattaattctgagatttgttatccagttcacaaattttgtcttcagctgtatctagtctataaatcaacttgtcaattgaattatttcaatgaatgtgcttcttatctagaattggtattgtttacatcattttttcatgcagccttcttcttgcctaatggtttctattcttctttttttcactttgagcatttttttttttttgagatggagtttccctcttgttgcccaggctggtgtgcagtggtgcgatctcggctcaccgcaacctctgcctcctgggttcaagcgactctcctgcctcagcctcccaagtagctgggattataggcatgcgccaccaagcccggctaattttttgtattttgagtggagacaggttttctccatgttggtcaggctggtctcaaactcccgacctcaggtgatccacctgcctcagcctcccaaagtgctgggattacaggcatgagccactgctcctggctgactttgagcattttaaacatagttattttaaagcatcttcccatttgttctgttttcttcagtgcttggggtgcagacatcttttgtttgtggtgactaatgcttctaacatgttttcttgttcttaactgtggtttgcactgtcttatagtcatccttactggggggaaactaattattttccacagacatcccttatacttcaggttagagaaccagacagtagtaccttttatgtagggggcatacattccaagactcccagtggatacctaaaatcatggatagtactgaacactatatatactattttttaatacatatatacctcttataaagtgtaatttataaatcaggcagaataagagatcaataactactaataaaatttaaaagttgtaaaaatatgctataataaaatttatgtggccgggcctggtggctcatgcctgtaatcccagcactttgggaggccgaggcgggtggatcacgaggtcagtagatcaagaccatcccggctgacatggtgaaaccccgtctctactaaaaatacaaaaaattagctgggcctggtggcaggcacctatagtcccagctacttgggaggctgaggcaggagaatggcgtgaacccagggggcggagcttgcactgagctgagatggaaccactgcactccagcctgggtgacagaataagactctgtctcaaaaaaaaaaaaagttatgtgaatgtggtctctctcaaaatatcttacagtagtactctcctattttgggaccatagttgaccacaagtaagtgaaatcatggaaagcaaaaccatagatgaagtgggacttctgtacttagaaagaagttaagcattaaccaatcctggacctgccatcctacctcttttctgctcagggtccatgaatcgcatgcatactgcgagtttgaatatcccagtcatcagcacagtccaggccttggtttccaacttcttggagtgattctttctccacccagtcaagctgatgaaaagtcttgtgcccttgacaaagtgctgattagtcctgcaaatgtagcagccttccgtggctttgtgcattcaggtcaggtcaagatttccttgtgactgtatcatttctcatcctttgattgccctcagccccagcttgtatctatctggtcctttcccaggggctaccttttttttttttttttttaaccctgtaggtttccttctctttgtttcaagcttaattaggtagtaaaaatgttgtgtttaatacttttatgtgtgtgtagctggtggagagattttccttatcagctcaattccccatattgaactgaaatcaccaaattactttcctatgccaccagcaacgtgtgagtattagtttctccatactgacagtagcattgttatcataaaatgtgtttcccctggtttaatggttgaaaatgatatattattacatgtaattttatacctcattacatataattttatatcactggttcatagagaacaaggaagtagatagaatgtgctttcctgaacagacgtgttagaaatgtatgtataaagggatttgttctttgaccttttgccattttttctcttctcatattcataggtccattgccagcacttgagtaaagataaagagtaggagaatcaaagctgttgtataattagttctcttctcatccacacccataaaccagttcaagaaagggatgaaggtaaagtacatagatgaagaagccacatttatttgtgctgcaggagcccttgtaatctcttcaaaacacctcctgtgaagccctctcacagacatagagcctggaagagtagattttttcactttccttgagtataagtgattttctttcagatggtgccatctctttctagaaagaatgtaagaaggcagaaaaaaaaaagaaaaacagagactatttaccatgaagagctatatcaatgtactcatttattatgatgataggatgttggtgcctggcagctgactattctattgcattagaattataggctcttttttccttcctttccctccctttctccctcctgcccttccttccttttctttctattttttttaacctctgttgtatgatccctctaaaaacgtagacagatatcaaagctttgctctcctaactagtatcagagataaactgctgacaagctgcattccatctccgtgcacattcgttgggagaactttcagcaaaaactatttatatcatctcaattttatttccagttaacctgacccatgttatattacacaatctttaaaaatgttcagattcccatattgcttcagctattttagactagtttcagaaaatagttttttggttcatgcttgtcgttttctgttcccttttgctaatgtgaattgaagacagcttagcattcttttttttttttttttactaaatctgagggtcagacaggtcttcagacagcagatttggcttccacagagaaaaggggaagagaagactgcagttggccagcatcttcagggtgtactgcctgttctctgcatttgatccatttcatgtaactgaaatgaacgttttcttacattatgctcgttcagtattttgctctaaaggaatgaagatagtgttgttaaggtgcagatactgggctgctcagtgtgactggtaattatttcctcttaagaattgccagagtataataatttaccatgtttttgtctattttattctcatttattagtgatcaaatatgttcaattttagtttcaattgattcttctcattataatgtgctttttaggtataatgcatgaagtgacttgatgtaagaagttataataagatatctgccttactgtaattctcttctaaacaagcaattcatgaaatagctcaaaggagcattgtgtttggcagatttggatgtctataccaatttccacttcttctgatgcaaacagtttcacattaaatctccaggaagttttgtttaaatgtgcttcagtttaaacaagcttaagtttattttatgcaataaaaatagttcgttgtgttaaaaaaatagatctttacaatttactaataaactacctattctacttaatgctttaggcaaaatttacagaaagggtacttttttgcttctttgtgcctactaccctattacccacaggttaaaccaaggactctggggttcatgtgcatttagtagtctccctgatgctgctgtgcctgggtgtagcagagagagctgaggaatgatctaaggtctgccagctccaaagtccagccctcccaggtctaccacggtacctaaaattctgcagttaaatactcaaaatttcagttaagatgtaccttcaaaaagacggggttgaattcagttataacctgagaaggttgacacactaagccactagcatgccagacacattagcactgactctttagatttcttacatcactttggaaagcaatcgttttgaaggtagtatggtggtggtatagggtaccaagaatgttaagaaaagaaatggagccgttaaaagggaaggaagaagaactccaaagataagtttttcttcttttaaagttttgtctaaggctgactccataataattttaacctttagggacagtagaaagctaaagactgaaagcaaataaatattacatgtaattggctctcacctccaatgatataggtaataataatggccatcatttattatgtatttgctatgtgccaggtgccatcttcttttattacagcctgacaaatttggcattatcatattcacctggaaaatcagaaactgaaggctcagcgaggatagacaatcacttattgggccagatacgtgttcaattgggttttagacccagcatgctccaattccagagccccctactttgttcatctcacctcatgattttcagtttcttgatctattatttttgccttgttaacaatttttaaatataattacttggaaaaaaatcactcggttaatgtctgaaagcatctactgacattagtgtagatacatttttaattggattagatcccatagttttatatgagagagcaaggagtgtcaggttctaaaaaagtcacctttaatttttttaaaaatgatttactaggaacccagtattatttctttcatggaattttcccatctagttctttacttttcattgcatttcacttttcttttctttgctcattttcctctgtatctactttgatcagctgtgatgttcaaagaaactcttctcggtgagataataactgccagccctagtttttggtgctgagttcttgactctttcctctgtcttcatatgcattttagtgtgatttggagtccccaccaggaggggctggccagatgcatctttaaaatcaaaagccactttctacttttaaaaggatactcattgaacaaatatatactgaatctaattaaaagccttagattaaatgaaagagatagtcagaggtagtttgatatgtagtctcgcaaaagaaaaagatacttaaaaagaaacaataagaaactaccaaggaataaaaaactatgaaggaataggaaggaattgaagcactttaaatgtttccaaatatttaaaatatagcatatacaatactaaaaatgaaagcattgctaagagctatcctggtaagcacaacagaatgactatgtttcagtttgaacagcttatatgacagaatttggatagtttttgcaaattaacatttactgatgaatttgagatatgtacaatggatactttaaaggtactccgtcatgtctacagtgtgtttttatgtatacccattttatatatgcccactgaatatacccatttttgggtaatggttcacaattgtttatactactttggatcttctgtttaaaatatatttgcatgattataatttaacgtgaacctcattgataatggtggatttataaccagaatatttgacatattcttagaaagcattagttttgtgttttgcagaaatttattctatgcagaattttcatgaatttgttcctatgttttcctttggtgctccttagcataatatggtagcagacagccttgggagttaaagttatattttacttttgtaatgtgcaagtgtcactaatatttgaataaagtagatgtgatgctttaatttgatttgatttttggctttgctagcaaatctgtgttcatctttgaatttcttatttatatgcttatgttttgatcactatattccacttccttttcaaatccttatttcataactccttaaattgaaggtatattttcagaacttctagtaaaatatctttgaacaacccagtctttttcatgggtagtttttcagatatagaatattaaatgtttatttccagaaagttagcatttctatcttgattcttcttcaatgcccataagaagaaaagaattgaaacatacttgaaataattgacatttagttctgattttttttcattgtttcagtatgaaacaatatattcacctattcatgtattataaactgttcatggttctggggatatagcagttaaccaaaatgagtccctgttttttggagattataatttagtgagaagaaacaggtaataaacaaatatacataacaggacaggggtgataatggttaatattaccagaaaaacaaagctaacataagaggaagggtaggaataggccaaaaagaaaggtaggtgcttgcatgttttgtgtatgtgtgtgtgtgtgtgtgtgtgtgtgtgtgtgtgtgtgctgtttttgagagcatggtcgtggaacggttcattgatgaggggatgttcataagagacctgaatgatgcaagaaaatgagtcatgaaacatctagagggggagctttccagggagaaggtcaagcaggtaccacagccctgaggccagaatatgtctgggaaaaaaaaaaaagtagtctgaaagctttggctgttttcttttagtaaagacttatagagttcgtattcagctaccatatctaattcatgttaaatagcacagtaaaagagaagtatgtgaattctgagaaaatggatatataataccaagaatactccatatatatcaattacatcccagtcattcattgtgtcatctcactgagtggtaaccagaaagagcacaagatttttagtctagcagatctatttccaaatccccattcttctgtcatgtacctactgagtgatgtttctaaggcaaaggacatgtaacagcagcaacaataaaagcagttcttatttattaatttatgaaatgtgttaacataaatcctagaaacataatgccccgctgactacatgtgcaagttatactgtcatcctgtctctgtttataaaagaaatttattttatttaagatttttatttgtctgcctgttgttctctgaatgggaactgactctggatttcattcagggctagtgtgtacacacatacagaggatgctgtttgcttagacaacctcaggtagcaccatttacattgttttccctggagttggtcagaatggatggtcattaactaaatcaagtgatcctggaatagattgaaagctcttgcatgcctttatcaaaataccaccatagagtagatgggaagagattttggaaatagtgatagcaatcactcacagttattgagtttgtactgctctaaattccaggctgtactctaaatgccttgcatggattagctcaccacagcctcggtacaattctgtgaggtatatgtagatgaggaaactgaattacagagagaaaaatcaaattataattgatatcaagctctgctttcctcttatttaatgttatcattaagttatttggtacagctattgttcaaacagtgtatatgcctttctgatgcaggaaatgagctatgaatccatctctgtgatgattgcatcatctcactgtagctggagtaatcagcctccagagataactgaatcttttagccaattatggtcagaagcagttcaaaatcacacacactaaaaccaaacttttctcatgggttagagtcttaacattctgatagtatgaaaacttccttctcccagtgattcattcatttacctgggatacaatcttcccatgaactcatttttgtgatgaaaggaagttatttttaaaaataaaaattaataccatttaatgtcaagatatctcttttgtactttagtgtagtattgttagggactcagtcatgcatgtgcttgactgaacttttgagcaaacccaaagccccttcctaataaaccatgttgaccctgctcaaaatcctcttcaggccacctgtacactgagatgcactggtcctgtgttgtgtaaatatatttaaatatgtgtttttattttcccagaaagccagcaacattgccatttagctacttacttcatgtctgaagtatatagacttccacctaacacttagcaatcacttagaagtttcattgataccaatgtgtatgctatctggtttttatctgaaagtcacctaaaatagttgatattccagaaaagaaagcaaaggaacatattatatagtttgaagtcacatcttcagaaagctatatacctaaactctattactttacacccctgtaaaatatatcttcattagatgtattgattttaaaaacatggctatatattggttttgtaagacatctttttaaaagttcgtacttgtaaagtcagcacattttataagtttttctacgaaaataatcagaaatgcccacaaacaaatacactaggatattaatcactacaatatagtagagaaaacatggaaaactctaaacgctgaatggtagagattagttacataaatagtaggatgcctgtatatggaggaactttaagctattttagaaaagaaaagcggttatgatctaataaacataaatgccaagttatgatagtatgtagagtatgatcactattttacttacgttttaatatatatacattataattgtatatatattggtattgctacatccagtatattttctctattttctacattttcatatgctctgaaagaaaatagtaatgtaaaaagagacatgacttctcaaaactcaagaattttacttctaattcacacacatatgtaacatgtaaaggggcattcattgctgtactatttctaagaactaacatttggaaacaacttcaaagtccagcaattagagattagattaataaaatatggtatattcataggatagaatataatgtagcatttcagcaaaaaaaattaaatttttgttcaccagcataagtagatcttaaaaaatgtgtgaagaaagcacaatacagagcagtatgtgtctactgttatgtcaatggattcactggtacataaaaatataaggaagcccacgaatctaatgacactggataccaactagaagaagaaatgagaatataagggggaaagggtctggttaaaagagacttcaataaatggatagatgaagtctgtaagcaaacgtaacaacttaataactgctagaggcatatggttctttcattattctttgtacttttccaggctttaagaaatttctcaaaaaattaaacacctaattgtaggcaagaaagtaaagacaaaatttagagcactcgaattttaccgtgaaggagagaagagaaaaacatcagaagcttgaggggaatacattgtcaatagattttttaaaaaggtgggatatactaaagctgtgttttgaattgagccatgactctttgatggtatatgaaatcaatgtaatgggtcattattgaccattccattattttagtccattatttaatggtccctccattatttttaatggaatctgtgcagaaaagtattaacagggttgggactgctgtttttagaaagtttttagaaagttctctttgtaagttttcttttaaagaaaatgtggcacataaacaccacggaatactgtgcagccataaaaaaaaggatgaagctggaaacatcattctctgcaaactaacacaggaacagaaaaccaaacaccacctgttctcactcataagtgggagctgaacaatgacaacacgtggacacagggaggggaacatcacacaccggggcctgtgagggggtggggggcaaggggaggaataacattaggtaatacctaatatagatgatgggttgatgggtgcagcaaacggccatggcacgcgtatacctatccaacaatcctgcacgttctgcacatgtatcacataaagcataataaaaaagaaatagttggaaattagaatcaataaggaagtgtataaaaaataatggtgtattttccatgggatactacgtagccatgaaaaggaatggtttcctctggacttggccccatgcaccttttctctttgcttcttttcccttttgctgcagtaaatcgtagctgtgagtacaacttaaaatttttaaaaagacatggtcatatgaaaatatgttttgaaaactttttatgacactgcctttcaatatgctttatgtaaatagtcatatgaatttccttagaattttatgcatggaaaacttcctcttgcccaatgagttactatatttttctttattgaacaaaaacagttatacaccatattgtatttttcatttgccttttcactgggaaactgttaaatgtggggattaattggtagttgtcctaagcaaggtttttgaatcagcagtattagctctttgatgaactggcagctgttccttctccatctttggtagctttatttgtctctattgtcacaagctgctttaaggttgttctgtggaattataaattagctatacaaaacaagtgtatgaatggctaaaataacaaggataacctatcttggggaaagaagacttctgtatagataatcttattatgagaagtgttcacatttctctgcacttgatactaggattatctgttctataggcctttaagctcaagtcttataaccctatcattaaaatagggattaaattcctttcttaattatgtatatttaaatgccattaactttggaaggttataattacatattaactgactgtatttttttattgtgggcactagtcattttaatctttctattcaaactgtgttcagtagttattctgatacaagcatagcataataaatgggttaacatatgcagtggtgaaaggtcaaaatgaaacatagcattgccaatactaagggaaagaattcactttataaaagagggtaccacatattttcacgaatcacattttctgatgcgtttaaaatattttggttacatccagtcttctagtagcacataatcaattgacttaaagtttttataagtgtaacaactatccatttctaacactagctattcaataatttgtggtagggtaacatggaattgtttaagaaaagttgtatgttttttatagagacatggtatgagggctccttactttcaaattagcattaattagaggtagtgtagaatcatataatgccactgttttatatctgtatcttgtacagtgttttaaataatttcttacttaagccttccccctttcatttgaggaaagttaacaattatctttatttttataagatcaggtgactaatggaaatccagggggcactggtattgagcaagaaaacagaattatttctagtattttcttcagaatttggctttagttttgcaacagaatgatctcattttatttaagggacagttctctttgagcacaagatttttgatgaaaacatagcatcttgtttgtgtttgttgaagacttttcaaacacattagcatttataaaacttgagctttaactcacaaagacagtgagagaaaaggaaaagccaacagtgaaccagaaatcagatttatttttagggaaaaaaaaggatagatggataaactgacttagcaaatctgtttgttaacttagacgattaaaaaaggaatatcaacaataaagaggctagtgtgcaccagtgaatctcagaaagtctttggtaaagatggtagtaggactagttgaaaacctaaataaggaagaggaatgctaccctcctcacctctcttgaccatgactaggtgactacccctctcccagagtaatgaagactggaggtgtgcactggaggtactgcagtgtggtgatatagatgcaccatactgaaagtagggaatctatggagaatccatataaagggtggtaagtctccccggactccatttggccacatgttccagcactaacagctggacatacacctccaggcataaaacttgaggattcttctctggggaaagtgtacagccccaaggaaaagatcctaggttactgctgcttgggacatttgatctcccagtaaaaaagcccgcttgcctctgatcacagagatgcaattagccaatgaggctggctcacagatcttccagttagcttcctactgcatctctcttaaatgcagatttcatgacacctccacgaggaggttgtacaccatttgaaaatcccttcctttgaaaatcacctgtcatcatctgtttttcaatcgtagctatttattttggtattaccttaatgtttccaaatatacttatgctcctacattagagattgacttcctattacaaaagattagaacttacaactctgctatctttcttaccattttacccacctccatccatcctctcgatagctatcatacagttttttgttaattaataatctacatttagaatactgtgactatataagcaacactttttattgctgagtctaacaatatatatgttattcttatatgactattacattcctaaacctaaattttcccctttttattttttagctttctatactaattacaaattaatttttaacccttattaccttttactctccacttgaattataaacctctccaaagatcattttccaccaaattagacgaataatttagtttctcaagttccatttttttccttcttacaggcacactgtctggtgccctctgtctttctccaacacttactggtgctaggcctgctacatttctccaacactgaagcccttggcctcctggattccatgttgcctgctctcttgcttgatgtccccttttttgcagtggggggggagtgaaaaaatcctttattaaaataatttatattaaaataacatgttgccatttttgcccaacagattaaagttgctgtttgcctcttagcttagtcagctttgtggagaagagcccagtaaccctgggcgagggactccaggtgctgtgaaggcatccagcctgtctcaaggggccaggtgctggtctctcttggtgccgcttttcccatgcagtgctgctggcgtgagttccctgtgccagacttcccaccctcagcagaacttcagacagagctgttcacgagaatgataaacagctaccattgcaattcgcagacacccgctggcttgggctcagatgtctgccaaggtcttgattattctattttagtgtatttcaacaaacaaatactaagtgcttactgtatgcagggcagggtcctggtgttccctaagatgccaagacaaatagaatgtggtatgtgcctatgagaagtatatgatccagagaaagagggcttgagacaaatcaatatctgttattaaaagggtagagaatgtgaaatgattttagaggcagacaaacaatattctgtgagcatttggtattcacaagtccgcctagtttttacttctatcatgcaggtctttctcagaatgacgggctggagcctagtcatccagatggtttgggactttatagaaccatgattcatggatgtgagatctggttgttgttgcctttttttttttaaattgccctgctttctgatgttaattactgcagctgggctgccaagtaaacatctgttccgggtaggattctagataaaggcgtattgctttggcttgtcttgttggaaactatttttacctcacatagaatattatataatctccatgaatactgtatactatgtatggactattacagatcaacacatgcctagaacattcacagaagaggggaaaacaacaaataaatactctaacatatattaaagcttacaattagtaagatacacacaagcattaaaataataatattgccatttttccttatcaaattaaaggcaaaagttttggagggtttttgtattttttcatttgtatgcttatttttctaaatgatagaattcatcatggcaagttgtaattactatcatggaacgtaaataaacatggcttttagaaagcagtttggcaatatgtgttaaaagtctcacaataatcagatactttaacccagtattttcagttctgggaatctaccctaaggaaacacagaatgaactttatgcaaaagttattcatcccacattatttataatagcattaagttggagacagcctccatgtggagtttaactgtggttcctctactctctgaagtattatacaatgttcagaaacaatgattatagacagtaataacatggaaaaagcttttttttttttttttgagacggagtcttggtctgtcaccaaggctggagtgcaatggcgcgatcttggctcactgcaacctgtacctcccggattcaagcaattctctgcctcagcctcccaagtagctgggattacaggtgcctgccaccatgcccgactaattttttgtatttttagtagagacggggtttcaccatcttggccaggctggtcttgaactcctgacctcgtgatctacccacctcggcctcccaaagtgctgggattacaggcgtgagccactgcacccggccagaaaatgcttaccttatgttacatggaaaagcaagttaccaagttgaattcagagtacatgtagaataaatatattctacaaggacttatatgaaaatgttgatattggtagtattaggatggtaagacaaagcctgattttttccccatttttctgttttcccagtttcctttataaagtcatttatcagctgtacaaacacaggtgaccttactttccctgtataactgaaaaattgactaggaagatcagacattgtgctcttcaataagtaagaacagccattcccaggattgtcattaaacactttcccatgccttcccccctttttttgagatggagtctcactctgtcacccaggctggagtgcactggcatgatctcagctcactgcaacttctgcctcccaggttcaagccattctcctgcctcagcctcccaagtagctgggatcacaagcatgcaccaccacacctggctaatttgtgttatttttagtagagatggggtttcaccatgttggccaggctgctctcgaactccttaccttaggtgaccacctaccttggcctcccaaagtgctgggattacaggcctgcaccaccatgcctggcctgttttcttactggttctaacaagtgaggcccacagcagatctatttggtttataggagaaaatacatttctattctccctcaaaacatgaagagattattcaacagttatgtaaaatttatatagctccattatatacagtacgaattcagtgaaattataggcagtaacagttttgaaaattaacacattaacaaaaataagtaacaattaatgttctttcacctgagcagcctaggaaactctggggaagttggactaggaaggatgagcaggctgacagggccagaaaggttttccttctctacatctctgccctttttctttcaattagcacattgagtgcaacagctgaactgcaaccagccaggggtgtggttgttcctttaagggaggctgggcttctggcctacatgtggcctctgccctggtagttaagactgaacatttttatcttcttataaaccagtgatcaaggccaatttggctgtcatctctccctaccccatgaaccccttaaaatagtccagaacaggatgctgatttttctacttacaattacacattacacgctagacaaaacaaacatacacaatcacacttccttccctttaatttatgtcccttggactagtggtctggtgctctcctttgtcacctatgtccctgcttgaccttgagttttctgtagctagagatcactatttagaaaaacctcacactatctctattaacctctttttgaatttcaacaattatttcttaagcacctactttatgtcaggttagtgagcaaggtattagagatgccagaataaacaaggcacagtttctgccctcaaagaatttataggataatagggaaaacaaacaattttgctagaataggataagtaaaaatgacaggaataagcacaggttgctacaggagcaagtcttgttaaggatcacctgatacagttttgaggtattacaaaaggcttccaaaagaatttgatgtctgaggtaagacctgaaggatttaagcaagaaaaatatgtgtaaagtatgtcctgggtagaacaaaagcatgcggaggagcccagaggcaaaatcaaatatgattgaggcatagcctgcaatggggcaaaagggagtccagaaaagtggtcacattttcacatggagggagttttcactttatcctgaacacaagggcattattgaagtattttaattagtggagttgtatgatcagacttgtgttgtaaaaagagtgctccagagaagagggcacccttgtatactgttggtgggaatgtaaagtagtacagccattacagaagacagtatggaggatcctcaaaaaacttaaaatagaactgccagatgatccagaatctcactattgcatctatatctcaaggaaatgaaattagtatgttgaagagatatctgtactcccatgctcattgtgccctgttcacaatagccaagatatggaaaccacctaagtgcccattgatagatgagtggataaagaatatctagtatatttaacaatgggatgttaatcagtctttagaaagaaggaaatactgtcatttgcagcaatatggatgaacctggaggacattacgttgagtaggatagaccaggcacagaaagacaaatgccacatggtccccctttatatatggaatcttaaaaagtcaaactcatagaagcagaaagcagaatgttggttaccaggggatgggcatggggggaaaaggactaaggagatgttgttcaagacatgcaaaatttctgttaggaggaataagttcaagcaacctattgtacagtatggtgactatagttagtaacaatgcattgtatacttgaaaattgccaagagagtagattttaagtactttcactgcaaataaataaatatgtgaggtaaacaaaatgaaacaaagagtactccaaagcctggactaagtagcattggagatcaaaagatgtaaatgattgtttgaagaattaataaagtaggattttgttgatggttgagggagagaggaagcagaagaaaagtcgggaggggatattactttgctttctgtgccattttcatgataaggaacatgaaggaggccaggcacggtggctcacgcctgtaatcccagcactttgggaggctgaggcaggcggatcacctgagctcaggagttcgagaccaccctgagcaacacggtaaaatcccatctccactaaaataccaaaaattagccaggcatggtggtgcacgcctgtaatcccagcactttgggaggctgaggcaggcggatcacctgagctcaggagttcgagaccaccctgagcaacacagtaaaatcctgtctccactaaaataccaaaaattagccagacatagcggtgcatgcctgtaatcccagctactcgggaggctgaggcacgagagaatctcttgagcccgggaggcagaggtcgcagtgagccaagatcatgccactgcactccagcctgggtgacagggtaagactctgtctcaaaaaaaaaaaaaaaaaaaaatgaaagtgggcagtcagggggacatgggaagtgatgagtttgtttttagactgttgagtttgaggtatttgactgaagacatcaagtagggaattaaacgtagatatcagaagcttagtatagagatctggactggtgttttaacatgtgggagcttgcactgtatatatatgtggagttgaaaccatgggagtggaagagtaactaaccctcagaaagattaaccaatgagaacaatccattataaatgcaacctcagagactcaggaagccttaaaggatagatgcagggaaaatccacaaaggaggatacaggggacagaaagaagtcaggaaaatcaggaatgtgatgtgctagaggtcaagaaagaaacagaactcaacagtgtcagatgttgcaaaggaggcagtaaagtaaggattcaaatggacatttagtaaccagaaggtgattgataattttgtagagaatgactgaaagtcatttcaaggaggaggtgagacagatagcagtgggttttttaatgtggacgtgaacacaagaacattaaataatctttcatttggcttggctgcaaatggacagatgataaggactggagaccaaggcacacaatcctaacgagttttttgttttcttttgcttttatagtgggagaaacttgagcatgcttatcagtttgagtgtctgaagttagcagagggaggtgagattcctgacaaggcaggtggaaataatcatcctagaaattttgcaaagtcctgctttctaccgaggagggagggaggaagggatatttccaaaggaaggaaggaaggaaggaagaaaagaaggaagggagggagggagggagggatatttccaaatgtactcccttatgagtggggaacagaaagttgaaggtgttctaaggaagggagggagtgaggaaagaagggagggatatttccaaatgtactcccttatgagtggggaacagaaagttgaaggtgttctagggagggaggaagggaaggagggagggagggagggagggaaggaaggaaggaaggaagggatatttacaaatgtactctcttatgagtggggaacagaaagttgaaggtgttctcagctgatcctgttggatttttattctgtcaagtacaaggtgaagtttttgactgtgtgcatattggtcagttgaaaggaaaagttaagagtaaggccttgaagagggaggtgaaatggttcatgggtaagaaagaagcaccccagagggtcccagagaaggttgctgctcagtgatgatagcccatatgatcgtggagaccatctgcttgtccacagcactgagggagatgaaagttagactgcttgtacttttcaaagtatcacatccaaaaatgtattacctgcctttgatgaagtacttaagaattctcagtggccgctagcaacatggcattattattctaagcagccagttttgcaaaacctgggtagacatctgcagtgacacagtggcaatgtgtccaggctctgccagtgactaacattgaattaaagctttagtactttctttctgggtgaccttgggcaaactaattctgtacttgggatcctggtagggtctttatcaggagtaactgaggttaatcaatggaaaatgcttagaatagtgcctggcacatactaaacgctcaacaaatgttagctgctgctatcatcatcatcgtcatcattatcattaagtttattgtgataataggataaatttctaggatgatacaattcaagcctttagagcattgagagcgtaaacgtgtcatcagtactccacatttctgtgtagaaagaatgacaaaaggtattcctgttttggggaagataactttgaaacaagtatttaaaacatttctctgagaaaaaaaaaagggaatcacagttaggtgctatacaagtcagctttttttaggtagggaaggttgcatattcagtccttaaactctgcaagaattgcactgcttccctgtgtgactcttgaccctgtggaagacaagtggggtgtgaaatctgcccaaatcatctcccttactggatgaaaaaaatgaaaacaaattaaaatgaactgtgatatactagttatagagtagtattattttcacatgcaaagagtaattgtgttttggatacagtaaatattaatattaatatattaatgtttattatatttgttgaatgaacatgacataatttgtaccattcttttttaaattttttaaactattttttaacatttttgtgggtacatagtaggtgtatatatttatggaatatatgagctgttttgatgtaagcatgcagtgtgagataagcacatcatggagaatgaggtatccatcccctcaagtatttatcctttgagttacaaaaaatccaattacattaagttattttaaaatacacaattaagttattattgactgtagtgatcctattgtgctatcaaatagtaggtcttattcattcttcctgggcttttttgtacccattaaccatccctacctccccgccaatgcccaactacccttcccagcctctagtaaccatccttctactctctatgtccgtgagttcaattgatgtgatttttagatcccagaaataagtgagaacatgcaatgtttgtctttctttgcctggcttatttcacctaacagaataatctgcaatttcctccatattgttgcaagtgacaggatgtcattcttttttatggctgaatagtactccattgtgtatatgtaccacattttctttaccatttgtctgttgatggacacttaggttgcttcgaaatcttagctgttgtaaacagagctgcaacaaacagaagtgtagagatctcttcaatatactgacttcctctcttttgggtatatacccagcagtgggattgctggatcatatggtagctcaattttcagttttttgaggaacctccaaactgttgtccatagtggttgtactaatttacattcccaccaaaagtgtacaaaggttcccttttctccatatcctcaccagtatttgttattgcctgtcttttggatacaagctgttttaactggggtgagacggtatctcttgtagttttgatttgcatttctctgacatcagtgatgttgagcatcttttcatatgcctgttcaccatttattcaaatcattgcccattttttaatcagattattagattttttcctgtagggttgtttggactccttatatattctggtgattaatttcttatcagaggagtagtttgaaaatactttctcccattctgtgggttgtctcttcactttgttggttatatctttgctgtgtagaagctttttaacttaatgtgatcccatttgtccaggtttgctttggttgcctgtgtgtcctattcttaatgccagatatagtttgttagtttatcttaatcccccttttttggttcagtacccctttaaatatatgacaaaatctgggagtatgtactcccaacaatgcacaggtgaacaacacacaaagataatttgaggaccccaagataggagcaccttttcatatgcctgtttgccatttgtaggtcttcttttgagaaatgtctattcaaatcttttgcccattttttattaggctattatatatttcttttggaactacactgagtgtatatagtgtatacagtgtatattttggaactatactgaatgaatatagtgcaaaatttcttttggaactacactgagtttctcactgtatatatttagtgtagttccaaaagaaatatgtttctagaatatatattatggcaaaatgtattataattcagttttaaaaagtggaaagagcataaaataaaactggaaataataactgatgcaaaattgcactatatgaaaatgcttaaattatgcaattattctctttttacacttgtacctgtgtttcacttaaaagagaatggtgtaagagctttttaaaataaggttttttttttagttttacttattatttactgtgttaaattactgtgatgtgttccactgggctttttttactgcttatgtaagtcttctgatgtgctgtcttactgcctttttatatattttatcttagctagttttcttaagtgaattatttcaatcaaacttcatatttgatctatctcagttgtaacatgtgagaaaatatttacctggttgaccaataacaaaatcaagaagttttaactgtattgaaattacccaaagaaattagaaagctcagttgaagcagaacaggattctctaaaatgtattttcaataacaagacatttaaaactgaatattccaatcccttttcaacctaattacaaactttgcagtaagagtttggagtatattctttcagcatggaagtcttttttggacacctctctaatccagtaatatttttaagagacacttatacccctagaatgagtttgttttctccctattttgaaggtattaaacatcaaaagcaaagacagctttttaaaaacatatatattcttttattttttcatattcaaatacactttgatttagttcctgggggatataaaggaaaatatggttcctctacactaaacagcattttatatttggaagtaatgaatagaagccaggaaggaggaaattatttctttctttattgaatctaaaaactccaggtaatgaacagaccattcgtagaactgggtggatggtgcacaaagatactttgttttggcatgaaaaggctccgttgaagtttctgttaaagaactatgttaacttggtttaacatctaagaaggcattgatacttgccaattttgaaagaccaaactctgtaggggggagaagtgtaaatgttgttggtaaaaatgtagaacgtgcattttttaaagtgtcaaacgttgattacctccaggtttgcagttattatcataagaaatgatcttgtcattatatctgttaagtagttttgaagatgaaaagttttggaataaaaaaaaatttttgaaatcagctacataaaaggaacattgctatctgtgaattagctgagatgacgacagcactgtgtagggtgggattcccatagggcttagtttacttgggacatagctgctttgttactccgttttcatgctgctgacaaagacatacctgagactgggaagaaaaagaggtataattggacttaagagttacacgtggctggggaggcctcagaatcatggcgggaggtgaaaggcatttcttacatggcagcagcaagagaaaatgaagaagaagcaaaagcagaaacccctgataaacccatcagatcttgtgagacttattcactatcacaagaatagcatgagaaagaccagcctccatgatttagttacctccccctgggtccctcccacaacacgtaggaattctgagagatacaattcaggttgagatttcagtgggggcacagccaaaccatatcattctgcccctggcccctctaaatctcatgtcctcacatttcaaaaacagtcatgccttcccaacagtcccccaaagtcttaactcatttcagcattaacccaaaagtccacagtccaaaatcccatctgagacaaggcaactcccttcctcctaagagtctgtaaaatcaaaagcaagctagttacttcctagatacaatgggaatacaggtattgggtaaatacagtcattccaaatgggagctattggccaaaaggccaaaacaaagggtttagagcgcccatgcaagtccaaaatccagtagggcagtccaattttaaagttccaaaatgatctcctttgattccaggtctcatatccaggtcacgctgatgcaagaggtgggttcccatggtcttgggcagttctgcatctgtggctttgcagggtacagtctccctcctggctgttttcatgggctggcattgagtgtctgcggcttttccaggcacacggtgcaagctgtcggtggatgtaccattctggggtctggaggacagtggccctcttcttgcagctccactagacggtgccccaatagggacactgtgtagggtctccgaccccacattttcctcccgcactgccctagcagaggttctacatgagggccctgcccctgcagcacacttttgcctgggcatccgggcgtttccctacatcttctgaaatgtaggtggaggtttccaaacctcagttcttgacttctttgcacatgcacgcggaacaccacatggaagctgtcaaggtttggagcttccaccctctgaagccacagcccgagctgtatgttggcctctttcagccatggctggagcagctgggacacagggcaccaagtccctcagctgcacacaccctggggactgtgggcccagcccacgaaaccactttttcctccagcgcctccaggcctgtgatgctaggagctgcgatgaaggcctctgacatggcctggagatattttactcatgatcttggggattaacattaggcttcttgctgtgtatgtgaatttctgcagctggcttgaatttttctgtagaaaatgggtttttcttttctatcacattgtcaggcttcaaattttccaaacatttacgctgtttcccttttaaaactgaatgcttttaacaacacccaagtcaactcttaaatgctttgctgcttagaaatttttttcatcagatactctaaatcatctctctcaagttcaaagtttcagttccacaaatctctagggcaggggcaaaaagctgccagtttcttcactgaatcataatgagagtcacctttgctctaattcccaacaagtttctcatctccatctgagaccacctcagcctggaccttcttgttcatatcactataagcattttcattaaagccattcagctagtctctaggaagttccaaactttcccacattttcctatcttcttctgagccctccaagctgttccaacctctgcctgttacctagttccaaagttggttccacattttcgggtatcttttcagcaatgccccactctactggtaccaatttactgtattagtccattttcacacttttgacaaagacatacacaagactgggaagaaaaagaggtttaattggacttacagttccgcatgtctggggaggcctcagaatcatggtgggaggtgaaaggcactccttacatggcagcagcaagagaaaatgaggaagatgcaaaagtggaaacccatcagatctcgtgagacttattcattatcacaagaatagcatgggaaagaccggccccccatgattcagttacctccccctgggtccctcccacaagtaggaattctgagaaatacaattcaagttgagatttgggtggggacacagccaaaccatatcagctgctttctccactacacagtaaagagggttaggagaaaacccataattcattagtgcaaagatatgggatagaaactgagactagcaaatgtattcagaaacaaacttaaaattcctaattcaattttgataggtagaactccatacccataattcttaataatctgtcttattgtcaagaccaatgcaaagatttggttttactgtcagttctgcatctaatatctaccatagttaggaaacacttatgccaaatatataaatatatatatatatttcttatctccagaatattttgtcaagtaaagaaagctaggtgaatattatttgctaacatttgggttaaatatttaagttaaaaaaggacaaaatatgtatatttgtatttcatgtatatactttaaaagtttctggaaggaaacgacaaccattttgtggggtgaatggagaaaagaggacagttgtaagagataattgtatgtctactttatactttttggtttatgaactatgatcatttttgagcttattttaaaaactgaattaaaaatttaaaaatttgcataagaggataagggagcacgaacattcagatagtaaggagggaagaaaagtttaagtaatgtaaaaaagatgattgtagaaaagtacatttggactggtttcatgaaacattaatatctcattaattgtacagttattattttaactgtaatattaaacattgttttggggaacctttaagtactatgataactctttccaaattacacgtgagtgtggttttattgtacttttccctgatgacttatgaagttgaatacattttcatatgctcactggccatttggacattgtcttttgtgaagtacccataaagtctcgactatttttctttttttttcttttttcaatatatccaaggccatataattaatacatttcagagtttggatttcaactaagatctgtttgcctacagattctgtgttctttttttttttttatacttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtatccatgtattctcattgttcagttcccatctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctactgtgaatagtgccgcaataaacatatgtgtgcatgtgtctttatagcagcatgatttatagtcctttgggtatatacccagtaatgggatggctgggtcaaatggtatttctagttcaagatccctgaggaatcgccacactgacttccacaatggttgaactagtttacagtcccaccaactgtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctattcattctgatggtagtttcttttgctgtgcagaagctctttagtttaattggagcccatttgtcaattttttcttttgttgccattgcttttggtgttttagacatgaagtctttgcccatgcctatgtcctgaatggtaatgcctaggttttgttctagggtttttatggttttaggtctaacatttaagtctttcattcatcttgaattaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcgacattatttctgagggctctgttctgttccattgatctatatctctgttttggtaccagtaccatgctgttttggttactgtagccttgtagtatagtttgaagtcaggtagcgtgatgcctccagctttgttcttttggcttaggattggcttggcgatgcaggctcttttttggttccatatgaactttaaagtagttttttccaattctgtgaagaaagtcattggtagcttgatggggatggcaactgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaaatattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggcagagacaatggggttttctagatatacaatgatgtcatctgcaaacagggacaatttgacttcctcttttcctagttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctctctctcggcagaaactctacaagccagaagagagtgggggccaatattcaacattcttaaagaaaagaattttcaacccagaatttcatatccagccaaactaagcttcataagtgaaggagaaataaaatactttacagactatttttcttatgggtttgttgtctgcatgtttctcattgctttggagttctttatatgttctggatatacaaaacttgtcattcatgtgttccaaatctcttctcacacttttgtttgcatttcttctctcttaaaaatattaattggtaaacaaagatttaaattataatcaatccagtttatcaaaatgttatggttttttaatgtcatgtgtaagaaatcttactctttcccaaggtcatgaagatgttctttttgattatctttagaagctttttcattcgccttttatatttacagttacagtctacctggtttgagttaaaagtcaagacttatttgtgggtttttttgtttttgtttgtttgtttgcagctcctcatctgttgaagttttttttttcaattttacttttatttatttattttattatattttaagttctgggatacatgtgcagaatgtgcaggattgttacataggtatacatgtgccatggtggtttgctgcacccatcaacccgtcatctaggctttaagccccgcatgcgatagttatttctcctaatgctatccctccccttgccccctaccccctgacaggcctcggtgtgtgatgttcccctccctgtgtccgtgtgttctaatcgttcgactcccacttatgagtgagaacatgcagtgtttggtttactgttcctgtgttagtttgctgagaatgatggtttccagcttcatccatgtccctgcaaaggacgtgaactcattcttttttatggctgcatagtattctatgctgtatatatgccacattttctttatccagtctatcattgatgggcatttgggttggttccaagtctttgctattgtgaatagtgctgcaataaacatacgtgtgcatgtgtctttatagtagaatgatttataatcctttgggtatatacccagtaatgggatttctgggtcaaatggtattcctggttccagatccaaaaggaatcgcaacaaaagccaaagttgacaaatgggatctaattaaactaaagagcttctgcacagcaaaagaaactatcatcagagtgaacaggcagcctacagagtgggagaaaatttttgcaatctatccatctgacaaggggctaatatccagaatctacaagtaacgtaaacatatttacaagaaaaaaaacatcaaaaagtggatgaaggatatgaacagacacttctcaaaagaaaacatttatgcagctaacaaacatgaaaaaatgctcatcatcgctggtcattagagaaatgcaaatcaaaaccacaatgagataccatctcatgccacttagaatggcgattaaaaagccaggaaataacagatgcttttattatttattatttattatatttattatatattatttattatttattataaagcaggaaataacagatggagaggaagtggagaaataggaatgcttttacactgttggtgggagtgtaaattagttcaaccattgtgaaagacagggtggcgattcttcaagactgatttttttaatggatattaaaccaacagcacaatttattgaaaaaaaaaaaaagtcctgcccactgccctgtagtgttcatatggaagtggtattgttctattctcttttctgttccattgttctattatctatccttgtgccactgtcacactaatgtaattcctatagctctatgatcagtcttatttctggcagaaaaagttttacaactttatttttctagatcaagagtattagtctattcaggctgttgtatcaaaataccagaaacggagtagcttttaaacaacaaactaccagcaaggcacttgaggctgaagttttctacttgggaatatgcctttttctctggttgcttcttgttactgtgtgtttggtattgatcacttttacttgatgtacttaaatgttttctttgtactgtatttatcttgcttagagtcaagagatttctggaatttttggcttgattttttaaatcatttttagaaaaattcaaaggcatctagcactaagccctgtagttgctgctgagtaaacaaaaaaccgtatgtgtcagtagagcaggcaccttcccataatcactgatgagtaaagtgaggcggacatcagtgagtctgaaatcaatctgccctgatggtgcacctcaaagtaattaatccacacaaactacctggagctgtgctttgcttgtagtagatctatgtatattttgtgattattgttactgctttcgttgcaatattctcttctctctgccatattaacatatttccatttttcaaaacagaggaaatatgaaattccctagtatcaagtgagcaaaatccaaagcaccttgtaaactatcatgaccaacacttacaaccatgatcagagtcataaactacacatttgataaattgagcaatgaggcctgagatttgtactttttcccgtccttttctttggagagtttaattaattagtctgccacttttccagaggtcttcatcacctgagtcattaaattacttttgagttctcccaggtggcaaattagccatgtagcttgaacgttaagtggataatagtgtctcttaatgatgccttgtagattcctttagagttaagcaattttttcctttcaagcatggaaatgtttttgttcagaaaaactgaacagcatctttttcagtgatataaatagttgtattagcattttacacacggagcagcaaaatatctttaagtacattaagtagataaaatccagtaaacagaagttagatgacatgttatttagaatgttaacttgatactaaaaaattgacatttttgtagatatatggtatcatggttatggttttaaaaagacttcttaattttttagccccatactgaaatatttatgaatgaaatgacatgatatctggtattttcttcaaaataacatgggagggccatattattcagggtatagaagaaataagattggctctaagttgacaatgtaagctagaggatggctatttaaggattcataatacccatctgccaaccttcacatatactttaattatccctaataaaaagttttttaaactattgggtaaatattaaatgaattaataccaacaaatcccaatttgctagaagactatcaatgccaatttaattgctacattctcaaggtctatgaaggcaggattcacggcttaattcactttatactatggactttttctatcacctatcctattgttaggagcttggtatgagtttttttgggtgtattaatgatctttttttctaatttaatttttaagttctgtgatacatatgcaggatgtgtaggtttgttgcataggtaaacgtgtgccatggtggtttgctgcaactatcaacccatcacctgggtactaagccccacatgcattagctgtttctcctaatgctctccctccctccaccccatcccctgacaagccacagtgtgtgttgttcccgcctgcccccatccctgctgtgtccatgtgttcttgttgttcaactcccacttgtaagtgagaacatgtgatgtttggttttctgttcctgctttagtttgctgaggataatagcttccagctccatccatgtccctgtaaaggacatggcctcattcctttttatggctgcatagtattccatggtgcatatgtaccacatttttttttcttttttaaaaaaattttactttaagttccaggatacatgtaccgaagcaagggttgcaatcctagtctctgattaaacagaccttaaaccaacaaagatcaaaaaagacaaagaagggcattacatagtggtaaagggatcaacacaacaagaagagctaactgtcctaaatatatatgcacccaatacaggagcacccagattcataaaacgagttcttagagacctacaaagagacttagactctcacacaataataatgggagactttaacaccacattttcaatattagacagatcaacaagacaaaattaacaaggacattgaggacttgaactcagctctggatcaagtagacctaatagacatctacagaactctccaccctaaattaacagaatatacgtttgtctcagtgccacatggcacttattctaaaatcaaccacataaatggaagtaaaacactcctcagcaaatgcaaaagaactgaaatcataacagacagtctctcagactacagtgcaatcaaattaaaatttaggattaagaaactcactcaaaaccacacaaccacatagaaattgaacaacctgctcctgaatgactcctgggtaaataacgaaattaaggcagaaatgaagaagttctttgaaaccagtaaggacaaagagacaacataccagaatctctgggacacagctaaagcaatgttaagagggaaatttagagcactaaatgcccacatcagaaagctggaaagatctgaaatcaacaccctaacatcacaactgtagagaagcaagagcaaacaaattcaaaagctaacagaagacaaaaaataactaagatcagagcagaattgaaggagatagagacatgaaaaaaccttcaaaaaaatcaatgaatccaggagctgtgtttttgaaaaaattaacaaaatagatagaccactagctagactaataaagaagaaaatagaggagaatcaaatagacacaataaaaatgataatggggatatcaccacggatcccacagcaatagaaactaccatcagagaatactataacacctctacacaaataaaccagaaaatctagaagaaatggataaatccctggacacatacaccctcccaagactaaaccaggaagaagttgaatccctgaatagaccaataacaagttctgaaattgaggcagtaattaatagcctaccacccaaaaaatgcccaggaccagatggattcactgctgaattctaccagaggtacagaggagctaatatcattccttctgaaactattccaaacaattgaaaaggagggactcctccgtaactcattttatgatgccagcatcatcctgattccaaaacctggcagagatacaacaaaaaaagaaaacttcaggccaaaatccctcatgaacattgaagcgaaaatcatcaataaaatactggcaaaccaaatccagcagcacatcaaaaagcttatccaccacgatcaagtcggcttcatccctgggatgcaagactgattcaacatatgcaaatcaataaacattatgtaatcataatcacataaacagaatcagtgacaaaaactacatgattatctcaatagatgcagaaaaggccttcgataaaattcaacattccttcatgttaactctcaataaattaggtattgatggaatatatctcaaaataataagagctgtttatgacaaacccatagccaatatcatactgaatggacaaaagctggaaacattccctttgaaaactggcacaagacaaggatgctctctctcaccactcctattaatgatctttgttctgacttctgttgaaaatgagcagtgaagcaatgcatttattaattagcttgattaatatatattgatctgtacatatatattaaaacatcatgttgtataccataaatacataaaatttttgtcaatttaaaaaaatctcattgattccacttccaaaatacaccctgtatcttgttacctctcagtcatctatcatctactgcctgtaacagctagacatcacttgtgggaagagccattgaatccagacttccagaattctcccaaccttcacttttattcctctgcagtctgttctccaagaagagcatgtcagtcctcctcataaaaccagtgatttgtattgtctttatataatacagactttttaccatggccaacaaggcccatgtgatctgtcttctgcctaactctccaacttcatctcatactgttctctccctcctttagtatatatttttgtcactgagttgtgtgctctgagcagaggcaaatcagacaccttctgactggagccaatgttcttgtttcctttgtttgctgtctcttccccatgttctctgcataacaggcctttcagttctcaactcaggttgtcatttccttagagattgcttccatgatgtgtagttcattcataacacaggttacaatctgtcttgtttatttgcttgtttactattcatttcctccagtagaaaccccatgtttccctctcctcttatctttccagaagtccatcacactacctagcccataaaaaccacatttcactgaaatctaagatgtgatcaattgtaggatgcagtattcggttatgcaccaccaagaaagtaaaaacactgcaaattaaactattgtgcaatactaatttcttttgattataaaaaacttggctttcgagaaaataaaatgtgcttttaaaatgcattcttgaattgatgaaatacatatcttgttgaacacatgaaaaactgtacttcacttaatcataattagttgtttgctagtgatcttttgaggaaaattttctgaaaaagatatgcatgtagaggccaagagattgcataggtgatgagtaacactatattatgaaaaagaggatattgttagtatgaagaagtatgagtaatcgaaggattgtatgagtagctgttccaaactgccaattactggcttgtcaacaatgattccaattctgtaggtcttgagtgggccatgaaactggaatgctcaacagacactttaagagactcatatccattgttccagaaatagattcagccctctacagggggaagacagaaaacagagatgtaaattgctagagctggtagtgggtaggtatgggaatatgcatctgattgcctctatgtgttcaataaaatatgaggtctttggttcagtgtagtaggatagggattttggagccttgagaaagaagggaaggtaaaaaatagtcaatgcagagagtatgaaagcaagaggaagtaatatattcttcggaaattgaatagatttgcagatttgagaaatactgcagtagaaaagaaggtgtttgattggatgttggatggtatcccgatgtggttgattaacaaatacccactgctgaaggagtatcaagacaacctgccctctttagctgccttggattgctctcgtccctaaactgcattcagtttccataacacctggcctttcctgagtggctgtgaaattgctgcttccattgctatcatttacatagttaaaataaaataaactcataggtgaagaaggctggattcaaacactgacctcagagtaaaaaattcaggctcttaatcacagaaatgtactgcttcccaataacaagtgcctctcgaggtggcccaagtaagccccttttctgtggacttgaaagaaactatctctcacattctgaaaactgcagttttctatttaaatagaaaaacatccagactcctaagatggcttcatgctctgcccttgtgctctggtcctagctggttcatctttgcttacagcctcatctttccttactcacactttgtggtccagtctgctgttcatctttaagagccgtcccaaggctgtgatctttaagttcagatgcatgtgcatttgggtgctatacaagttgatccaattggggtatgctagtgctgtgttctctttcctccaggcctttgcccaagttgtctctttcatctgcttgaaaccccttctcacttttgtttggctaaatcctgctagtcttaagctctcacttgaatcctcacttcttccaagaaacctcttctgatccccccaggtctgagattactatacttctcctgaaaacctgtactcaccattttgcatcctgattgcctctttactgacatgttcctgcaaagcttcagtacctagcccgtacctgcctcagaattgtgctccataaatgcctacagaatattaaaagaggaaacatttaatcattttttaatgtttaagttataaacttcattaagccaggttcttagttggttacacaggggtttttatctacacaaaaatctcctgagaagttttgtcttgaggcagaacaaaataattgattctaaaacgtaatttgaattataatagcatcgtaacactgtaacatgaataataaaatctattgggactgtgagcagactcatccaaaaaaatagaaaaaagtgtttgggcacatatttttaaatcctctctgggccatgttttgtacagtagtagcataaaattatgcaacaatttatacttttaacaggtcaatactaataaggagaattatccaaagccaccctctttcattttgctttcagcttagctcatgtccttttctggtattcaatatgtcaccccatgcatccttcagcctgcaacttcttaactaccttacctcaagtttgtgccagataaatagcaatgttaaaagttactatgaatttagtttttttttttaattgctttttgtagtgatgtttttctttccccaaactgcgtggctttctcccattcctacctcagtcttcatagcatgcttttctactccaagtgcgcatgttttgctttctgagaatgtgagattcacccaaataaaaaagaaagggtttggtgttgtttgtcatttggagtttttagtgcctccctgtactacattaggatggacaaaagagattgtaatgccatgaatataaagagttattgttcactacttacgaaaaatactctagctactcattatttcaaagtagtttattttaatcatttaaaaattagttgtgtccacactttgtgctttaatcttttattgtaatttttaatgctaaacatatctagtactccataacacatgctaaatgttgcgttttgatgtatcctcccttctctcctaatctagcttcgtagtcctttgaatacattaattttgtaaattaccgcagtagcagccagatttcataaggatgttttacattgttgtaactggtttcattttcttacttgttcctatgattctcattatataggaactacttactttatgttcttaacacagaagggtcagaggaaacagttattttttgtaacaatttttaaactattaggcattatacattacaaaatcttttgttcttttaaaatagtaaaatgtgcccagagtttagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgagatgataatttgcttctttggtgagcctgtggcttaggtccatttcttttcacaaaaaagaatgatcagagaagacttaaatgccctataagtcatttcagaaacattacgtagtgattattttggtattgcctaaagcaggtatcaaggtgattaacattcattatgttatcttaaaaattacacacaatcctttattgcggtcatgaaataagtaatactgtatacaaaaaaaaaaatgaaagaaaataaccagtgacgtttttttccttccatctgctcttccatcatgcaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaagtaagcattttcaccagagctgtgggttagatgtcacatggcagaagcagccagattagatccacttgtcgtgggcattaagggggcatctttcctttatggagctgaaggtgagcatatattggccatcattctgaaagcatatggtttggggaggctgatgataagagagtgctcttaaggaattaattacagttttgtctttgactttaaccatgttgaaaattaatctagtaaccttataggaaggctgatctttagagtaataatagttactactaccaaatactaaataaatactaaggctttttctttattattatggacttgatttttttttcagtggtcccaatgtaagtctcctcttgttctgtctataataggtaaaaatagtataaatggtactcattcatttattcagcaaatacagaatgctgtatatgctaggcagtgtgctaaatttgggggctatagagcaaatgtgatacagtccctgcttcaaaaaaagtcgaagatgggagagacatgtgttctaaaaatgacagtccaatatgattagaaaaaaacacaaagctgtgtacatatagtgtgctttgaggacacttgaaggagggttaggctctaggatgtcaggaatggcttcacagaggaggtgcagttctccagacagataaacctggtgagcatttcagagcaagggatgagtaagtgcacggcccccgaggctaaggccaggcttcttgtaatcaagtgcttctagagctggtggagagtcgggagaggcagctgatcgggcagataagagcagatcatgttgagtcttgtgcagtttgcgcagaagtttggatgtaactctgtaagcattagagaaatgtcatctggcagcattcatagaagctatcacaagaggaccagacagaagtctggtttgaaaccaaggcaacaactgtgacagcagagcattgattcacagccctgattgtatattagaatcacccgagaacttccatgacacaccagtgccccaggcccaccccagaacaattgtcttccaaatttttgagcctcaccaggtgactaatccacagtagagaatctttgcagtaaatgaagcagaaaaccagtgaggctgtggcagtagttttcatccttgtcattacagcaaaatggcaggatgaagtggtttcaaaggctgtttggagtcatctccatttaaggtaagtttctggtcatgttccctttcttgagagcagcagttacattattcattttgtagctttgaggggaccatggtttagcaggtagtttcctctgctgttgcagttataagctacagtattgtaggttagtcaaagcttcttcatgagtcgttgttctttgaaactgcttggctctcatagttaatttatttactgtttttatgcaggccattctctatcaggtataactgttagaaaaaaatcctatttttctcttctataaaaagcattatttttgaggttacaaaaattgtataactaaagtactgccctacagtggtgttgaaggctaactgaacattaatagaatacttttatttcatgctatatatccttagattatttttaagttattttcattgcaattgtatgttattgtataagatcaggaaattactagttttagaaggactcgtaattccataaattaggatattcaatttttttctaatatatgtttggacttagatacatagaaactgagactatactaatttttaaaattgcagtaattaaaacatgtacaaaattgaattagagtgggaataactgagtaacttttaaatgtgttgtttttatgaaatgggtaaaggagttataatttaagtcacaattatggcaatagtgaaatgttttacgtctcatttcatctgaaatcaccaaaatcatgttgtgatgagcataatgtatcacaatacacatgtattgagagtgaaatatgtaaaaattgacaaatagaagattctatatttgtgtaattttgagcgagcccatggtattctgataacatttcccagaggtcaggcttctccaatgtctatcaatttgttgtaggtaagaagagaagcaggggcaaatggaccaacatcttaaatttattaaactcaattgattccttttgattagtagaggaaaagaaaatttgctttggtgtgaggaggaattcaacaacacaataaatgttgattatgaagcagttaagatcctcagatcaacatcttaaatttattaaactcaattgattccttttgattagtagaggaaaagaaaatttgctttggtgtgaggaggaattcaacaacaccataaatgttgattatgaagcagttaagatcctcagcggtgggtgtggggtggaaatctcattacactataaaatgaaacttaagcaaatttcaaaagagtaaaactaccacagaatttgaggatgattatttttgttactcttctttactagtgtagaagagaagatcgataacagaagaagttaataatctccttgatctatgctgtacaaagttctagcaatgattcaaataattcctgaagcaataatttttacttattttagtgtaaagtttatataacatttttcatcattaaactctgtggtttatgttaacattaactacctggtttacatgcccatacctgtctgggtattataggtaaggagagcactgacatggataccccagccaaccaatcgtgagattcatggccacagtatggcaccctgtactgagactaagatctttgttctttgtgatgaacaggtgaacattttttattttgcagtatttttaaaaattcagtttccctaataaaataaggtagttccaaattggtgtcatttatggtaactttaagaggagtgaattcaagtactcacacacaatacattgcatcatgaggcaacagaaatagaaaaaaaaaggttgctgctaatgtctgacgtttctgtgcaatttaacgtctctttataataatgtttacaggcttaagtaggtttgtatctactgataaaacccttgtaatgtttattttaatgttattctgagtcattgattcacagtatcttcatccaagatgtcattctttgaacatttattatggcttttgctgtcaattcaactgtttgaaaatattatagctattttatagctgagtaagtgcttctcacatgaagtttgagacctaaaatatcatatatgggggttttaatttttgtgaagaccacttgttaaattgtttgtactcagcaggtggataaagggtaaaaagaatataagaataagcagtaactagaactcttacctgtccatttgtccttccaggcccaacacccaacaattcccttctggcaaaaatctgagtaaatagagctttatattatgttctgaacatcgtcaaactcatactatatcaaatagaacaagtgcattcgtgaattgagagatttacattcagacaaccttgccttttgtcaaatccagtctcactttttcatccatagtatttctgtcttcttctccctaaaactcttgtcatgatgccagaaaggcttaccgttccatttctacaaggttgacgtcagcttccaactagaaatctaatttctaacctgaatagttcctgtaatttatcagtgcaacagcaaccgcttatcaatatagagaacaagttaatgatggagaaataaaaaaatgttgaagttttgactaatgtccttatgttatgcctggagatagacacatcacccacacccaaagcttttcaccatagcaattatcacctgggattttatgatatatatgtgtggttatttgccttaagtttctctttctaactggtctctgggagtccaggtccaagtttacttcatttactgctgataacctgtgtcaagcctatgtctgatagagggtgcactcaaaatatatttgttgaaggattcatttaagagtaaacacattaagccttgaggtgttggatttaccaaggttgaaaaggcaggtcagagcactgctttcacactggaattaaactctcagcctgtcacacactagctctgtcaccttgagtatcgtttccacgtctttaactggggatagtaatagtacctatgtcataagaatgtagtaagaattaaatgaaatcacacatataaattacttagcaccacatatgacacatactggaaagtattatgattgttattattattaggcaaagagagcagaatgagcaaccctgggtattgagaagggcatgggggagtaaaaaagaatatagttgaaagaaaacatggggtgagtggtggacaatgggcagaaaggaggggtaaaattgactatgtctggaagaggaggagcaggtttgggaaatggaaaattagttcagtttgaaatatgttgatagtgttaagtttgaagaccctttagggcatcaaagagatgtccagaaaacatgactcaggagtgatttggtggaagtcatcaatattgggggcagtgaaggggattgtcattgaacttacgaaaatgaaaaaaatattctttgggaggtagaggaggtgatagcagttctttatggaagagaggagagatgtgtaaaggattaaaagtagttattttactcatacaggttttactgaggtaggtgcaattctgggtttcattcttattccaagtgcagactgaataaatgatcccccttttcatatcgatttggagaaagagttgaaggtcatgcttatcaacatgttagagaacacgttagaggtaattcttttgatggttttcttcagacaagactaataatccccattcttcttcccacaaatgttaagcagaatcttgataatttatacaatggcacttttgatgcatctttcaccccaggtgaaagaaaaaagccaataaaattccctggagaaactctgtctgtgtgcttaccttatctctctagctgtctttttttctttcttataaaccctctgagtagaaattacattttataaacactacacaaatattttctcatgtggtaaaagaattttctaagggctttaagaatacagtcaaatcaatcggttgttgcgaactggtgtactttaaaacgtgcttaaccttcctcctggtaaagataacttgagaactgtttcccatatataagaatgtgtaaagctttcccatgaacgtgtaatgagtatgctgctttgttctggttttccctgacaccatcactttaagttgacagtgtttacaaatggagaatctagttgtgcgtcttccctgcaaggttagggtagcttacaacacacactgatttctcttgggattaatgtatcactcatgtcaggagcccatagaaaaaaagtgtagtttcttaaatggttgttgttggcatagatttatgagacagttaaagtcgtctagccctgttgatagacgccagtgtaaacaaagtgtgtgttacatacattacccttgaaaaaacatataacactcagctatgatgcaagcctactaaattatgttagcatttctttcttcagttactaatggagtgttttgctaaggctgttctttgtttgcttttttgatgcataaattagacacaatatttttagaggtttttaacttgtgcttgaacttctaacagccaaatgttggaatttatctgatattttagcctacacttcacctaaaaaaacaaactatagtaataatcaaatcttgcagctaggataaattgacctgcactggtactaagaactgttttccctttatcctattgtcattgggtctttagcacaatgaacaagtgaagaatcgtctctctctgatggcccccgagatcgtgtgttaaagtaggccaagtgtggtgttccttataaaatggtctggaagatattctgaaagaagtgaagtgaagaccttacatttcttatctaccaccctctgtgctactacctttccatatttacttacttagatttgtaagagaatctactggggctgtctacacagtgcacggatcccctctacaatatgcctaccagttggccatgcagactctgaacactgcttttgttaaggaacttgttaatagaatcattcctttccattttcaaaaacctcagatttgaaataattcattgttacctttaggctgaggtatgcttccctcctgccttcacttattggtcacagagaatattcccatttccttatgtacacttaacacagtggacctcttgctactttatgtgggtacctcttgtgagctgttatcctgattctgttgtgttcagaacaggacatcttgttcaaaacaggatgataccacatttttctggccaggactttgggctatgcaaatcagggaagaattttccagtaccctttgtgttcaccagtgaagaaatgggtcctcggacaagaaatagacccagacaaatgcttctctgggctttgctctctggatttacaggaagagtctgtaaatgctgaaggtgtttccaggtggtaggagcaagatggactgatatgaaatagtgattttcaaattagggagagagtactttttcaaacaacccccattctcaagttcagacatgctgtccaagaaaagtatgagtccagcttgaacataaaagctagtattgaggtgaatgcattgtgcaataaataattgtgttgcatatgtaaaaggaaaccaatgttgagggagttcagtaaggttatttatataaataagcaccatatctcaatatagcttaccttgtcatgcgttttgtgtgtgtgtgtgtgtgtgtgtgtgtgtgtgtgtggttttatttgttttgttttgttttgttttgttttggtctgctgttggtcctcagcctttaggaaagtttctctttccctttccagcttagttttagctgtgctgtgagaaactaaggcaaggatcacttggccacatttggactgttttcaagggtgcagtgcctcatgaagactgtatgttactggcatttccatgcagggaagagatccccaagtaggcagtgaaatatcagggagtaagattaaagacaagaagtcaaaatatgttttcccatatggagaatttctttccattgccaccatctgactttaggatttgatgttataagggagcaaacagtgcttccttgaaagtatttgaagccattcatcaagactcattttctcctctctataacatgctgtacctctccacatctcatcttcaagaaaagcatcttcagtttttaaaacatttttataactacaagatttcccaattatttaccattttggttagtttctttaggacatacccgaatctgacagccatgatttttacatgtttcctatgcagagtttctggaccatggtatattttgggggacatgccaggattataggaacttactggctccatttattgtacacttagcaaggatcagggttgagctagctgaagtgacatctctgttcaggctacattagaacacttgctgtttccccaatatatcatgtgctcttgggcctctgtgtggtggctcaggatggaccctctattcaaagtgttacctcatcacttgtccctgtaacattctactcattgttgaaggccacattctctctgaacgcttatgttccagcttcactgaagcctctttccatggcactcacttgtcccagcttctattctggcagttactatatgcctttatagctcttttggtttatatctgtcagaccccagtaagttccttaaggacaagtattttcatttttttctgcctacaatcaacataagcagttcctgctacttgaaggtgcccaataaatatgtgttggatgggaaaatgaattgatacatgtgcttcattattgagaatctgaacctgaggttctagtaaagcaaatcctttttggaaaactgaatcagctcttatatttgcagtgctactttacacatggatgttgtctaatattttgaatttgataagtaatgattttgtgatttatttaaaataatgatgtgtataggggtatctagaatttaggcaggaaaataatgatctggggttttctttagttttagacactgtttttattttgtgggttgtttccttactcgacttgatgaattatcaggagaaaatgccattttcttagggcaggtgagtcggcgtactttcatctcagtatagcacagatttctggtaaaactaagggtattcaaaagtcaaaaatctaatgtaaggttcttttatcttttgtgagttctggagaaagctaattaagattcttagctctgataactttattcttgaagcacttgaagccctgcttgcctcttttagaagagtttgtgcgttgatcatagtgcttagtaaaagttcattaggacaatgtatttagtaaacatcatctgataatataggaattagtaatactacctcagccactagtcataaattagatatgttggtttttctttgaattcatttaatgttaactgatacgtgatacctaaactgtgtgtaaaatcattcattttacatgagacaaagcctttgacaaacacagttcactgaggagtgaacttgtgggctgttggagagattagacatctacatccctaatggaagttccataagaaaggtactgaatctggttgcaagaaatagggaagacatcttgaagaaaggagcatttgatcaagataagattttaataggtttaatccactggactcttccagttaccagaagcagaaatgtactgtttcttgggctacctcaattagtgaggtttagtctaaggctccatggggagcaggaagggcaggaaaatactctctgcagctgcccaggcaggcctcatagagaatcagacacaagctctggtagtgtgagagcccttctgtcatctcaccagaagtcaatgtctgtgtccttctccagtggtctgcattgtagtcatttagctcttctctgtctttgcctccatgaaggcatcctttgtatctctatgacactcctcaagagagaaaaatctatcttggctaatttccattcaacaatgagcacccatgctacacaaagctcatgccaccgcttaggcagcttgccaactagtggatacatgtttttggcttagggactcattcctggtccaataaattgtggcctgggcgatgcagtcacatggtatagagcagtgcctctcaaactttaggatgcatacaaatcaccttcggaccttgtgaaaatgtgcacttttggctctgaggtctaaggattcatgaattctgtgtttccaacaagttctcaggtgatgctgatgtttctggccctgcaaccacactttgagccacaaggacagggcatgatgatttctgtgtgactgtaattactaagaaggcaggcactccatgtggtgggtatgtggttgtgagatagcatttcatgtggaagaataactgtaaataaaagagtggaggaagatgcagtgttgatgtctgtatgtgtttgcgtaaggccaattttgaatatggttaagttcaaaatgaatgaggcatcttcagaacaaaaaatctgggacaatttcagatgtagtcttttaataccaaagttgttggagttggctattagtccttttatggttttaatccaaagcaaataaagagtgattctgatgttttcagtgagagatagtaagcaatccagtatgagtttaacttatttgtattcacttgagagactgccccataactctggtcacagtttcccactaagtctgtgctgttggtgaggatttgcaataggatctgcagtaggacttggttgtttattatgagccagagtccctggtttggacacaaagcgtcagattctttattattctgatgccttaggagaatcatgcattgctataattgtcttcattagagattcacaaatgtgatagttcagcacttaatcacaaagatctttgagtcattaaatgtctgacatttatagagcgaatccgagtttcaaagcatctttacattcattctaatatttcataaatataatctaagactgattaaaaactagagagatcttttcaaaaagttcatttaatgatgctagaatctagtgattcagaattatgaataatgtccaatagaagataaccgaattaacttttcaggtgttctgacttaatgttagatgcataaggaaaagcaatttttttccttctttcctcatttcattcattatattggaaaggaaggctccatgtgatatttacatctagtcttcattgctcaatggcaaatggaagtaaacattttatattgttttcttagctgaatctcatctacttcaacttgttttcttttaaaaatgatttattttaattgtaatgatcaaaaaggaaaacagttattttaaataactaaagagtaacatcctttttttcttttttcatttttttacttaaaccaagtagtttctcaatttatataagtagatcttgaaaagaattttcaaagttcaccttatcttggtaatcatgtggaattctgacttattgaatagtttaatgatatgaccatctttgactactacattttaagttgtcaattgtcaaagaacaaatgccgtttagtataagactatagtgaaaattatgctaaacttggagccagacaaacttacgtttaaattccttcttaacacatatgtgctgtgttaccttcagcaagttatttaatctatctgagtctcatttccatcatctgtaaactgatgatgttcatatctaccttccagcattattttgaggatgaaaataaataatgcatgtaatatattcaacatagacattatcattgaacagaattttaataaataaataaacgtgaaaatcttttaagccttatgacagaataccatttttatataaagttaataacaaaagtacttttacttcatagttgcacaagaggagcattatccattcttgacataagtgaaaattacagtgctttgagttattaacagaagagctgtgattgtaattgccactcagctaattagtctatatagtagaacctccattgtcaaaaaagttgttttccaaaaaggaaattctaactaacctttaaaatgtagtcagtgaattcacacatgctgcagtgacgtgacatagaggagcaaagagagtggtcagttataaatatcattcataatgagacattttattaatccattgtaatcacatggggctctgtaagtcaggttatacccatatgcttttagagagttaggagtggaaataatgtgtatgagtggaatattccactatcattcaaaataaaggaagtcagataaaatatcctccatgtcaagtggaagacagatattcatattaaacttacacgtgcactgtcatatacccctccacatagtgaaatatgaaggcccgtttctgacggttttctaagtacaggccacagggccactatattgatatatttctaataatagaatgctttgcattgtttttataattagcctgccttacgttggtagcaaaccaggagtatccattattttaaatgctgcttcatagcaaatgctgttctagcagtttgtttgttactgtgtttttattgttgttgttgttgttttgagatggtctctctctgtcgcccatgctggagtgcagtggcacaatctcggctcgactgcaacctccgcctcctgggttcaagtgattgtcatgtctcgtgtcatcctcctgagtagctgggattacaagcatgcaccaacatgcccacctaatttttatatttttcgtagagatggggtttcaccatgttggccaggctgggctttaactcctgacctcaagtgatctagccgcctcagcctcccaaagtgctaggattacaggcataagccaccacacccagactgctactgtgttttttatttgatgaagcatctgtggggctttttaaaaataaaatgaaataagccattcttaagaagacaatggaaatggctgggtaattcgttcaaaggaaaggtgaattaaagggcagcctgagtgtgtggatttggggccttgtgagccttcaggttcaatctgggagactgcacttaaatctgggagattttcttaaagctaaattggtttccagaaccaaatgtttaactccagtacagcctacaaatagccaagtcatccttgccaaagcaattctttcctgtagtaacagagtattcatatcttcctgtagtttgagtcttatagagggggaggtattttaaattataaacttttagctaatttccccaagcatcaccttcttatccttttagacactttcagtatatccactagtaattaatatgatttttttcttacacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaaggtgagataacttttaggaggaaaagaaaaaacatgtacatctggatgtgactgaacaatatttacattattgaagggaattataactgtcttaatgcaggtatgtggaaaaagagtattgctcttttattttggaaaagtaattatataattaaactgaaaatttttataaaccatgtatattcttatttttgcattactcttcaaaatttaaggaggccacatataaatattgacttaagacattgaggtccttatattacatttaaaaatgaggatgtactttataggaaaaatatagcgtaaaagtgatataaaagtataagttctagtctgccacgtgtactataattacttctcaattatataggctttgaatccttgcgatcttttgcttttctttccttgctgacattgctgatcacttaaaaattacattaaattgaactgattgttttgcttttttgcaaatctggtaaagtaaaagctcatagctaaaatcaggacttagggattttatgaatcccacttttcatctttcttttgataatcatgcaagtaatcaagaactagcaggcaatttgagctcagacctagatgtgttgaaagttagccaagcaaacagccagggaagactctcctacgggaggtcagccagtaaattcaaccagaaaactttggacttgatgtctatagtatagggatctgttgaagtttgaaagttttaaaaaatcttactgtagaaaatcatgtgtgtgtaccctttgccttatgtggttcctaccctttgccaaatttatttttggaaataatctctaaattggcctaattatcttttaagcacaattctgcaattacttcttggagacttagcaccagataaatgaaacttgaattgccagaaaatgtttaaaatttaaaaattatgaatacaattggaagtaaaagtatattctaagcctataaatgagcataataataataaatgtacagatttactataccaaattcacatactggtttataaatatagtaaggaaaagtattgtatgaaataacgtgttgcatttttagcaattggaagaaatttttgaaatagtttagatgacctggctttctaatagaagtgatgtctaaagatatttggcctaaagttttctttgttttccttgtagaaggcaaattcatccacagtcacccattttgttttagagctatttcagatcactgcatcggttgctcagtatacttatttttcattccattaaagaacaactagaaaatgaggccttcccccctttctcttgcctttttagtttattcaaagctactgctcagtttcaaacaaaacaaagaccagtaggaacttagagtgctgttaagttattctacttaacagttattcataagtgcattttatatcctttggaaagctgtaaaaacaattccaagttagcctggttctacaactggatttggaatgagcaccactgcagcattatacgttggggaaattctgaataaactgatgtaacacaaaatacatacatttgttactgtaatctcttaacccaaccttaaatggactataatgtaaaggaagaaaaagaagccgaccatggggaatttactgaatgttctaacaactttccacagttgtaacaaatgtagataaactgttaagagaaagcataaatgctggttcccctttgaagtaatagctaaaaggtcagggctttaaaagggattaccttttaaatagctgaaaggaaaagaaccatggaatcagtggacattattacattgtagcagagagcctactttctggtgggatttgggttctgtgaagtttctgtctgtttaagtcatattttatgatgtgtttggagtataaatggtttcatttttctttctcttttaagcatgactttaaaactttaccttttttcttggaccctaaaattatgttttgccccatggaacatttctattattacaacagaaacctatgaggagatattactgagtgaattaatatttgttttatactgtaaggctttcttttcataaatatatcttttaccatttataaatataaaataggaagatggtaggaatttgagtaaaagaaatgaagaatttctcacataatgcctccaggtaaacaattatcacatattttcatataaatgctttcaatcatgataactaaatgtatttaaaattttgttaggaaagtatatatgtgtatacacacacacacacacacacacacatatatatttgtaccctactataggtatatgttttaattagttcataattttagtaaatattgttatttatttatttattttgagacagagtcttgctctgtttcccagcctggagtataatggcacgatctcggctcactgcaaccttcgcctcccaggctcaagcaattctcatgcctcagcctcccaagtagctgggattacaggcatgagccaccatgcctgagtaatttttgtttcttcagtagagacggggtttcaccatgttggccaggttggtctcaaactcctgacctcaagtggtccacccgcctcagcctcccaaagtgctggaattacaggtatgagccaccacgccaaaccatattttgatttccaaatgatttgtttatcaaggtgatataacatcagatagaaatttggaaaagagagggaaaatattcacccagaattctgccgccccagtgtacttactcctaacatcttattgtgtgcccttggtctttcaccctatttaaatggctttttaaaaagttttagttgtgatgttcaaataatttaatatcattactattttcacctaacattgcaaacatttctcatattactgagtagttttcaaaacatttatttcattaaccatgaactgtgtaacacttgcttaaatattcctccactattggataccaaggcttgcttggtttgttctgggatttaaaaaattgtgtattataaataatgtgttgatgatattcatctagaattttttttccatattttatacctttgaaagcatatatttataaaggtagaatgactgggttaaagaatacctaagtttttagtatttagcacatattggcaatttgctttctaaaaggaatgaatcaatttataattccacctagaaagtttgaggacctgtttcagtatgagcatttgttggcattttaagtattttttaaatattaatttaataattttaaaatattttttcttgtattttatattttcctgtttgcttgtaaactgaatataaattcatgtatttttgagtttgtaatgcccccttttaaaattttctgttcataccctttgcccatttatgtgggacagattggggcatatttttattatcaaattttatgagctctttatttagatatttaaactccacttctggcattattgtctccacattttccctgttttctatttcttcctttttatttgagtggtaggttttcgtttttttttaaattaattgatttgcatatgtattgtttagtttttttatttttgttttactaaatatgttattctctttctttgtggtcaaatacacaagcacatatgtcgtatgaacacatatttttatatatttacatatctttgtatatcttttgtaaatatgttgcttctgagtttaaaaagtcattcagaagtttgattaaaagttcaattttctttctttatttgattttttaatattttaactctttaatccaaccataatttattttagtgcttattatgcattgggtacctgaagtaatattttttccaaattgaaaccatctaacccaattgtgtttatgggatgactttcccctcatcaattgatttgtaatttctctctaaattatatcttaaattacaatatcttaaattataatacataatagtctcttttcttgctgctgatttttaaagaaaattctgtacttacactggtgagttttaaacgattatgcctttgttaaatttgctaatctaagcaaggtttgataatctattaattcattattttaattagtattctaaatgaaacaaaattttatcttatttatgtattaagcattacttctctcttagtgagtttttacctttttctcaaatggatagaccaatttaatacatgatatagtattatgaagagatttgacttgtgcttagaaatcaaaatttttatttataattgtattttggcaggtaatcaggatgaacattaaaatttttttcctcatgatcaagatacttacttacaagtatgatttttatagtacgataaaaatatacaaacatatctagaattaatttatagaatatttttatgaaaacataacccaccacattaaggtcaactttacttagccatttttatttgaatcttattgttccttttgtttgtttgtttgtttttgttttttttgagatggagtctcactcttttcacccgggatggagtgcagtggtgctatctcggctcactgcaaccttcgtctcccgggctcaagagattctcctgcgtcagtctcccaagtagctgggattacaggtgcccaccaccatgcccggctaatttttgtatttttagtagagacgaggtttcaccacgttgaccagcttatctcgaactcctgatctcaggtgatccgcccacctcagcctcccaaagtgttggattacaggcgtgagccactgcctcattgcttcttaatgcaaagtatttttcagtcacttatgaaacaccattttttatcttaacaatgagttttctatttaatgtaaattcttaacctatggaaaatatgtgctaattttgaaatgtcttctttagttatcttagttatcacaaaaataaatctagtttgtagacttagtcattacaaaaccaagtctagttcgtaatagttttaatattaaatttaaagcaagtaggcaatctaaattttgttggaggtatcagaatatttgttcaatgtcatgcaaaaattcattttagactgttttataccacagattagatactaaagtctgagttaagaagaaaagtttctaagtcaaaaattaaaagtgagatgcatgctaaaaataacaaacacaggattatacgttataaaagcaaataaacagttaatgagcactgtcacacatacactaaattgtaatttattttattctaaggtcaacatattcattatttctagatgacaggaagttacttttatgtttttaaaagaaagatcaaatgtgcatagtcatttctggattctgatacgccatctctatacaaagtacctttgtccggtgctctttgtttgtggtgttatcacagtaataataacactaacatgtactgacatttattgcatgtcagtctcctctgtagttactataaatatattgtctcatccaaacttcagatgtgatactaagattctgattttcagtgtaccactcagatcatcactattaagtgatttgataaaactttaaggttttgcacaataattataacataacaggattggtagtatgtaagtttcatttgttgtctcaattctcaaaagaaagttgtaaacaagaggtaattaccaccatttcaagatgcagaaccagtttcagagagtttaagtaatgaccaaaaaagcaagcagaaaaaaagtgaattgtatttattcataatttattataaatttggaattagagggatttacttgtcatgatatttccctttagatattttattctcttcaatcctataatagaatgctttgggcaagaatgtattgattcaaagaaaatgaataatcttcccctgttcacataaggtcaacacaaaagctatttttttggtcttttatatctgtggctatgtaacttgcagttgctgaaataagaatccgaagtattaatgttgcatcttataggtatcctgcaattccttagtacttcatatatcactacaaaagcacattcagaggctgactactttcaaataatgcacattcagaggctgactactttcaaataatgcccattcaggataaaatagcttttccctaactactgataaaccatttttaactctccagattgcttaaaatcactaaatctggagcaggggttatcattggcactgtttttatggtatgccaagctctagaccttagttgttagaagcatgattgtttgacggcacatactttggaggatattaactacattgtatccaatgccctgtttttatgacaagtaatgttagtacttgcttacggtcctgagattaaatataatgtgactacctataatattttattttaaaaatcaatatgttgtcttagttataaaatagaaataagtgaaaatattgtaatgaaataatgcatattttaacatgtaaatactcagatatcatcaaattttatggttcctaaaatgaagaagtaaaagaggaaatgaagaaataatgaagcagtcaaatttgtgcatgcatttagatttaagaaaccttgaagtgaaatttgaatgttatcaatacctatcctttatatttaatattttaaaatgaggacaaaataagtacgtgtgtatatattatttttatatgtatatcacatgtcatctatacttgtatgtatatacacatacatatttatgtgtgtgtatgtacgtgtgtatatatatatagttagggtactagaaaatgtagtgtaccttaaaaccatgcaaacatattttggacttacatataaagtagaattagcttctgaatataaccaatctcatcaatttacacagtagttatataactgaaaaattcattgtatattaaaactatgcaatcacgccggtaatcccagcactttgggaggccgaggcgggcggatcacgaggtcaggagatcgagatcatcctggctaacacggtgaaactccgtctctactaaaaataaaaaataaaagataaaaaaaaaattagctggacgtagtggcagtcgcttgtagtcccagctacttgggaggctgaggcaggagaatggcttgaacccaggaggcagaggttgcagtgagccgagatgacgccactgcactccagccttggcagcagagtgagactctgtctcaaaaaaaaaaaaaaaaaaaagtcatggaaatgttattttgtgtttatacgtaaaatagagtttggttctaacttaagatatttcaaacagagttttaccaatatgaatgtccgatgcatttaaaaattacatgagaaaagctcaattctgtattgtgcaggatattctaagcattgcaggacatacataaatgccagccccaccatctttgtgacaactagacactccagcaacaactaaattctgaagcgtctcctggggcatgagagcacctgttgagagctgtgttatagatgatgagggcttctgcaaaggatgaaatccagtgatctatgtagacaagaaattgagtaaaaagctgcccattttccatgtgggtgctgatggagacatttttgctaaaggatctaaagctttcttaatgtaattcattagtttccattttcatttcttttcaggttttaagagttgctttctctttctacagcaaactacacatagaattaaaaacagggcacacatttagctgttggctcagtcggtaggcaaatcgtaaagttttggggaactgtgagaaaagctatatatccaaatagctactcaacatcttcaaccggatctaatagacttctccaacgcagtatgttctcttctccccaaaatggttcttctcatagcttctctgtctcagtaaatggccactccagtcttccagctgctcaggccaagaactttaggttatcccagactctgcttctttcatttcccatgtctggtgagtcattaagttttgtagattgtgccactaaaatgtatttagaatctgaccatatctcagtacccccactatcactaacctggggcaaggcatcatcgtctttctctctgcaggattttcatgtacctcctaactggtatctcattcttcacaacgttcttaacccagcagctagaatgatgctgttaaacataacgcagattacatcactctgctcaaaattgtctgtggttcctatctgacacagagcaaaagttagttctatgatgaccatagaacccgtcgccctctggacatgtccccactctgtgactcctctagtcatatctttccttccttcaccctgctacagtcaaatttcactgctggctgtgcttcgaaactgcaggtattctcccttctcaggatctcagacttgccttgtccctctgtctggaatgttcttaccacagatgtgtgcactgccagctctctcacttcttacatgtttttgaggaaaattcagcttctcagtaaaacttcccttggtcaccttatctaaaatttcaaaccaccgtcccctacctcagtaggtactatcccctcccatatgccttattttttctccatggtattatattacttatcactacttaaaataatgaacatattttgcagctgtgagagcagagatttgatctattttattgtctgagttacctctagtatttagagctgctgccaggctttggatagcactaaataatagataatggctgaataaataaatgaatatactttttcattctaccttatatggacttttaatgagaatttgttgtgtgccctgtaggatgtggttctttttcttgtggaacttgcagaaggggagacatagtccttagactgacaatgataaacactattgcacttcagtggaatgttgcaggagtattatacgagggttcatggcgaaaggactcaacaccatcttgaggaatccaagggagctaggttgtggaggattgttgggtggattatggcatgatgaaaggtatccagaagagggagattacaattaaaactgcaaaggcacagagccaggaagtgtttgatgtctctaggagccacaggcactttgtggttaacttagcgtaaggtttatgcaaggaagtggtgagaggtggggctggagaagccaacaagagctgggactttgcaaacaacattaagatagttgggttttatcctccagactataggggccattgaaaaataaaagcaggagagtagtggtatcagatttatattttaggttggctgcttgttgattttatggtgctagctgtagacatctgaaagaaaaataatgacaatatgaactaggccagttgtcaaagggctggaggagaaaagaactagataaatattatggggctaaaactatctgaccttgatggaaagttgaatgtgggaagtaaaaacaggataaccaccaaatatttagtatgggtatctaaatggatggtgataccataaactaaaataaaataatggagacagagttagagttatttattttttgttgcagtggtgagccatgaaatgatgatgagtttggttttgttcacttgactttgaaatggctgtgagggatataggtatatctgactagcaaacagttactatgtgagtcagaagctcaggagccaggtcctcagtagagataaagatctacctttgttggaataaagttgaaaccattcgaatgtggaagtgatcactcaaggagcaaatgcaaagtggtgagtcctggatggaattaagggcttggtgaaggaacaggaacctcagagaggagaggagaaactggaaaaaagatgtcactgaagcaatagtgtatcaaaggtcagtaaggaggtactgagcgactgattaagtgacacagagctacaataagataaaaatttaaaacatgttcattatattttgcagatgggggtcatggataatattcatgtgtttttttaaaaagtatttattaagaacatgctgtgtgttggtactgtgcacagctctttaatgagataatgaaaaagaagtacctgatctgggcccctgtagattttatagactggaagagtagagagtctgaatggagggatacagataattaaagagttttaaaatgtagagtgaggaatgctgcaacagggctagtgcagggtgcttctcaattagtagatacaatgccataaatatgctgtatttagaattctctccctacctttaagtccccttaactggagaactgctacttgtccttcatttcttagatcaaatgtcattttcttagagaaacctcctctgacccttacaccagatcaagctcatctattgagtactgtcttcatactttctacttttccttcacagcatttggcatagcttatgaatatatatttgttagtacaattgattactctctgtctacacctataagctccttaagggcaggagccatgtcagactttatcagtgagaaaatattttttcatgcatttggcatagcttatgcatatatatttgtttatacagttggttaatgtctgtatacatgtataagctctttaaaggcaggagccctgtcagattttatcaatgaacaaagtaattatttgttgaatgaaaaaatgaatgaaagacagctagatgtttcaagaacatgggattgcagtcagcttaggaggaattgagatgcaagtaagaacaatgagtagtattctttggaaaaatttggtaaatatgaaaaggtgaaggtaatcattgggtagagggccaggtggaatgaaaggaaggatttagtaggatgacatgtataatcacagagaggagaggtgaagatgaagctgaaggaggggaaaactggcatctgaagatttctgagaacatggggcagtgggatcaagggaagtggtgtggtaaagaagaaggaagaaaactaggctcatttattgtacggctctaccctgaggaataagatttggacagtatactacactttaatgaattcttgtcattataaattaatcataagacttaacttgaaacatgaaattttctgtaacaaaaaaagaactcagtacattggagacaattattgctatcagagtgttggccttaaaaagctaacattatagcaagagacaccaaataattttgaaatcagcatctatttatttttgcagcatagtctactgtgatagaagcagctgtttcttattcatttggagttttacacctgataattacctctaaatagtagtcttttacacctagtccttgatattttctattgactccctgacatggcagttgaggattcattttacttacttgaattcagctgcattcatattgctgcaaaggatgtgatttcattcttctttatggctcagtagtattccatgatctatatataccacattttctttatccagtccactgttgatgggcacctaggttgattcagtttgtttgctattgtgaatagtgctgcaatgaaaatgcaagtgcatctttttcatgaactattttcttttgggtatatccccagtaataggactcctgggtccaactgtagttctaagttctttgagaaatctccaaactgctttccacagtgattgaactaatccacattcccagcaatagtgtataagcattcccttttctttgcagcctcaccagcatctgttgttttttgactttttaataatacccattctgactggtgtgaaatctcaggggattttttttatttcaatagtttttggggtaccgttggtttttggttacatgggtaaattctttagtggtgatttctgagattatagtgcacccattatccgagcagtgtacactgtacccattacattatgcctcatccctttcccactcttacctcctattcctagtccccaaacttcatgagatcatctttatacctttgcatccccatagcttagctcccacttataattgagaccatacaacatttggttttccattcctgagttacttcacttagagtaatggcctccagctccatccaagtttctgcaaaagacattatttcatttcttttatgctcttcagtagtattccatggtgtatatatagcatgttttctttatccactcattgattgttgggtacttagattggttccacatctttgcagttgtgaattgtgctgctataaacatgtgcgtgcacatgtatttttcatataatgatgtctgtccttttggatagatattcagcagcaggattgctggatcaaatgatagctttacttttagttcttcaaggaatctgttttccatagtgattgtactaacttgcagttccacaaacataaaagtgttttcttttcaccacattcacaccaacatctattgttttttgactttttaattatggccattcttgtaggagtaaggtggtatctcattgtgtttttaatttgcatttccctgataattagtgatgctgagcattttttcatatgtttgttgactgttggtatctcttcttttgagaaatgtctattcatgtcctttgtccacttttttatgggatttgtttgagtttcaggaaatttttttaaagctttccttgtaacttttgtttctaattaattcttccaggtatcaaaagtcattgaaggaaacacatatataaaaatactttcaaaaatgaattagaggttaggattttatctagagtaaaatatttgttgggggcagtaatacataacagtcaacttagttatcaaatgctgcttaaacaataaagtaagccttcatttcttggtgaaactggagacaaatacttgtgggcagatgtatactgatttagtcataaaacattgtaggtttagcagttcatttactgttattcttctaccttatgattaggtagaaccttgtttgaaaataaaaggccacattccagttcttttttttagatactttgtgggcattttattgaattaaatgtaaacaacttgaggaggacaggtactattttcttcatgcagatggttcccaagttaggatggtctgacatgatttcgacttttcttacgatttttcaacttttccatgatgtgaaagtaacatgcgtttggtagaaaccatatttcaaattttgaatttcgatcttttcccaggctcaaagtaagctgggcagtggcagcgagctgtgcagctggcagtcacccgtgccatcacgagggtgaacaactgatactcacagtggactgggttgccagcattttttggatattgtgttttgttttttcacatcccatgtctacaaattgcccattttcaacctatgatattttcaacttggagcatctgcctacatatgtgtgtgtgtgtgtgtgtgtgtgtgtgtgtgtgtgtgtgtgtgtgtgtgtgtatatcttattacaggttttaatccatcctgtgaagaatatcctaggcacaaaaatggctccttgtgtcatttccatctactacaatgtggacttaatatcaaactcttataagggaatatctagcttattctgaacatttcatcttatgaccttaagtatagaaagatataagtaatgcttggtgcctaaatattcaattccttaaatgtcagtcatccttatttgttatagatagaagaaactatgagtactaacaattcaaatgtcattcatgatttatgagtggccagttttatctaatggattaggattatctagtctttctccatcttttaagtaaaaagagaattttgatactaaattttagccacttgggcagttagtttattttttagcagagctaaactcatgaatatttttggagctataataaaaaataaaaacagcttcattgagaacaaaatgaactttctgtaaatataatttaaacctatgttttaaggctttgtgttttaaaaacaaagatgacactgttaaagtgagactgataaaggtgtacttggggaattcatcagcataagaaatgtattatcccctggtagtacgagtttaaaattacaacttgcttagcaaatgtgaaaaataatgtctcctgttgcagattgcattttgctagtttatttctctgttagtgtcaaataaaatattcatatataatcaagatatattcataataatattaaaggcagcactgtgtacttgacagttggtaaatgatgaaacaattttttccgtgattatgtgtataaaatactcaaattaatctatagagccatataatcccaaaatgtacaaggttactatagagcttacaattttaccacttcctgtacagaaatattatttgaccaacggtattttagttgcctgctgcatttggaatataataatactaataaggaaagactgttaaaagagaaaggctagaaagtgcaaacttatttaaatgaaataataaataggccacataaagattttagaacccaatgaagcaatattacaaacagatataaaattacagtgaaaattatatgtgaaatatgaggcaaaacttattagaacaagtttttctgtcaggaaaagtgatgccatttgaaggaagaatggcacagaatggcaaaaacaagaagacacagatataccttgtggagggagagctgacatgtttgtctgactggttggcaaataatatgattgatcttctggtgttaccttttaagttcatcataagaggctacttagcataataaagaaacacatggattcaaaatctttctcactcacgaggattatcactcaggcagattacttttctgaactctgtttatgaagaagaatgccaatctcatggtgcagttataaggcttaaaagtgctaatctgtgtacaatgcttggcacataataggctctacgcaaaaattagcgctctttccttggtagatcacccacgacactgctatcagtgtcaaatcaggaaatttgttaagtcgtattatctccactttaagatcaaacacaatatatagtcaaaaagttgaatgtacgatgctttgggttttcggcagttgtcttcaaatatgtcctagtgctcatgtggtttaaataaggatcagaaatgattcagaggtccagtagggctgttggcctgtggtattcctaatgccatttactgtgctaaatggatgtggctacagtaaccattgataaacatgaacaacagagggtaagtgctggactaggagctgactcacagaaagctaaagggcttaagcttcaaagaccttcacctgcacaggccccttcttaggccttgtatctaatttgtctttgtaagttggattattttgcttaaagaaggattctcaaattaaacaatctacaggccttgcaaaacctggatccactgctactggtctgtcatgtaaaaggaaaaaaatcactatgactaaaaaagttagataaggcaacccatagcaagaaacatgagttttgcttttcttgcccaaatcatgatttgttggtaactctcgaccctaggtgcttatatgcccttgaccacacacttgcctatctaggaaagcactctctagtccagcatcagcctaagaattgcccatatgaagaagtaagaaaggggactgcctggcagtccaggaacttgcagttaaattacccgggtatttgatttctggcatttttaggtgggtaaaggggaataagtagatgggaaacaactttatattgacctgactccatatgtgccaaaacgagtttggcactgtgcataggttatcacattttacactggttggtagggaatattatctaacttgacacttgggagaggtaaagtaacttctttttaaacagctagtggagctagaattcaaacacagggctttgtgaagtcaaagctcatgttctttccaacctctctgtaaggcagaagcttacctgccaagtgtcagtcacccactggaaaggaatggacatttcacctcccagttcacctaacgattttgaatacataaagtcctgccagccaattgacaaacttttctttcttggtcccttcatttccccatgtatgaagtgcccgcctgtaatatgctgtgttccacttaattattacttcttcaaaatgatcacagtcaccaagaaactctccagttaggtaggtcggtagacagaagataggtagatagatagatagatagatagatagatagatagatagatagatagatagatagggatgggaggaagggggagagagaggtgttatcttttaagtgacatttttgtgattactatgattaatggccgttattagttcacaagcagcctcatgagttcttttgaaattcatattgttccattaaattgcagttttatattttagttatttaatccctaaaactgaaatactgcacataatttggagttaggaacttcaaaaactttttattcctaaaagctatacaacaaggttttattttaaagtaaagaaaaattttcatctctcaaccttttcatttctcctttcacagaactcttctctttttcctggatgattttatcccacctccataatcattgaccagtttttttaatgcagttataactacactacttcagacattcaaataaatacactgtattaggggaaggaaaggataattttaaaggaaatatgcagagttttagcttatggctaagacttgactgacaagagtcaaacaactactgaaggatttgacacacttgttaattgtaaaactcccaattgctttaaaacattcactgacactctagtcccgaaacaacacaatgaatagaagcctccactagtcaaaatggtatcaggagcattttcaataaaatttctaagcaaagaactcacatgtgaatgaataaagatgtgacttgagcaagtacctactccaagtgcaagcttgtccaacctgtggaccacttgctgcccaggacagctttgaatgcagcccaacactaatttgtaaactttcttaaaacattatgagatggtttttgcaattttttttagctcatcagctatcattagtgttagtgtgttttatgtgtggcccaagacaattcttcttcttctagtgtggtcaaaagattggacacccctgccgtagtgaagtagtagactatttttaggaggtctcattttagtaacaggagaactgggcaattgtattagtccattatcatgctgctatgaagaaatacctgagactgggtaatttataaagaaaagaggtttaattgactcatggttccgcatgcctggggaggcctcaggaaacttacaatcatggcagaaggcacatcttcacagggcagcaggagagagaatgaatgcaagcaggggaaatgccagacgcttacaaaactatcagaacttctgagactcactcattatcacaagggcagcatgaaggaaactgcccccatgatccaattccctccacttgaccctgcccttgacacgtggggattgttacaattcaaggtgatatttaggtgggaatacagagccaaaccatatcagcaatgtaaccaaaatattatgtattttgattaaataatgttaagttaaactatgttgtcttttatgattattcatgcaacaaagtacgcacagataaagatggctctaatttctatacaatatctttccatgaggattctgagttgagtttccaattttatcgcaaagagtaaagtcttgattataacatggtctcactgcttgaggcggtgactaccacactgtatgttatatatggtgtatgtatatataccataccaccactgtatggtatatatggtatacatatatatgtatatatggtgaactacccaaaaatgaaatccttgttacatgatgggtgaagctgtgtttacatgtaacttgactgcaacaatagaggaaggtgcttagttgcacagatggtattgtacaaacagttctacaaacaacacatttacaaataatattagagctgaaaactaaaaaggtattgcaaatacatttatatctgctataatttccttcaacaaagagacctctgctttttggtatttattcacaaaaacttttatgtaatcctttcttttaaggaatactgtttatctctgcttattcccccaagttggctcattcttgctgatcatagcataaacaaaatatactttcaaagcattttaaattgcctcctaaccgttgaattaggtgtatgtctggaaagataaatgtgtcttccttggaatgtgtttgcttttatattggtcaagataagccaacagcttgagtacctgaaatattatcaagctttgcacacatgaaagtatttggtaaaaggataatcttggagggtatgattataagcaaattcacagcctcaggagtgctgtgagagacttttattttggtgaaactggtaagtgttgtttcataaaatttgcgattttgctttttaaaaactcagctaactctttccttctccttccctctcttgctgatacagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtggtgagtgtctgacatacttatgggtgtcttccctgggaattaagtagtgaaaatagaacttggaaatgtgcagccatggtaattcagagcacctgccatgtgcccagtgttcagaggaggatattctctcaccctttaagaataaaatttaaaacttaaattttgttaccaggacactacttatatgagcaagtagtaattttgtttgaaaaagcagcttattaatcacacgcagaaatctgaagttatttgcctcttaaatttctgaaaccctgtcgtaagccacttaacaagaggggcagtgtcatgtatatttttgtaatggacaatatccagcagcaggtcgtacacatatcctccactcattcatggaggacctgcaatacagtacagcatggagcgtagcctaggaaggcaggggaaaaaatctaccttttagagccctgtaatagagttccattatgtctatataagtgataagttgcatatatttttcattgttttaattattaataggtaacagttaatataataagtatcaaatgccctcagtgcatacaaacccaagtttaattatccaagtgaaaatgcttttgtggattgactttttaccccctcttcctcaacaacacatagtagcctcatacacaaccccttcccacactggtacacaagtatgcaaatagaaacacagacacctgcccataaacaaatcaccctggccaaatgccactgcctttgggtaatgcagggttcttcggcggaatatttcttcttctgctcctctggaatgtattccattccctgctgctctggaatgtaaccatgtgagatttcttcccctttttcatcacatggatgtctgttagaattccttttctggccgtgtttctcatgtgtaggcaatactttttatcatcttccacatttccgttttccttcctacttttgcctagttgctttatgaaaatctttatatctctccttagcccttggtcacttcatgactgttgtgaaccattttcctccttagaagcatatgatacctgatcagaacaaagctgatgttagtgatagatttctatcaggtaaaagatagaacatgtatacgcaaatgcactttcacatatggaaaccaatgccgtcattttctaaaatctatgtgatctctataaaaatattcttcctgaggttaatggaacataattttccacagccaatagcattcaatagtcaagactgcttttaatgattttccagtgcgtgccgcttcttaatttgcaaatatggtggatgttataattatataaccaatatgtatgtattagttaaacagatattggagggataactagggaatctaaccttaacctctaataccatgagaaaatcaattgcaaattaagttctgagatagaagctgtttgcaaatctgtatatggagagagcaacatgaaaacacaaaatcactgtattttttgcattgttattttattttctacttcagtgccacctttaatttggtcgtggcagtgtgtttccgtccattctttattttaaatagagaagtcatttatttggctcatggttctggaggctgagcagtccaagatgtagtggctgcatctggtgagggcctttgtgctgcaccatagcatggcagaagggccagcaagcccacgagacacagaaaatgggagccaaacttacccttttgtcaggaacccactcccttgataactaacacgctcctatgatagtggtattaatccagtcataagggctctgctctcaagatctaatcacctcttaaaggcccaacctcccaacctcctttttggcctgtcttttgtgtgtgcaggcgcatgtgtgcaaataaaatcacatcaggttaagcttgtcaaagtagggagcagctggctttaagataaactctctcatccacacatattttccccaccccaagcacagctgcctcttaactgctgttggaccataactccaagtgaagtggtcctccctcccccatctccacaaatagcaggaaaagtaatgttgtaatttacaaagttacttactccctgccatttcagagagaagatggagtataggaaagccctcccacccactgtccttgtgtgatgtgacacaacttgctccctcagtcttggaatacagcctcatgtggtccttggccagaggcagagaaagggccttcatctctctcacagctgaagggtgggaaacatggtcttcattccgtgtaaccacgtgctcagctagagatcagaggttctgctcataaattataaaggagaagagagatttggggatgattagcagcctctgacataggggcatctcccccagtgaggcgtgggcagattattaaaggaatggtactgggaataaaagtggctgaggataaattttaaattctcatattacttcttacaaaaattctaagttttaaatcaagtcgtataatttttaagaataggtcttcaattgatttctagatggcaaataatttatataaacaaaaacaatggagccttctccaaaaatgaatactcaattaaaaaaaaaaaaaaagacaagcctggagccagaattgaagaaatacaaatagccaatacatatgttcaaaaatattcagtgttactagctgtcagagaaatgtaaattggcagtctcaaaatgagatactttgagtattattaacttgataagacatctgctaactattgattagcaaatgttttatcaagttaatacttaatattggactttcatacttaatgaattgaaattttgtacaattcttttgcaaagaaatttgatactaatgtgaaggccattttaaaacatgataaatctagataaactgaaaatgggttatgtgcaagtataatttaaaatagggaaaagaaacaaaaaattaagtataggaatatttaaataaaatacgatatatggatatgatagcaattaaaaatgatgttttagagcaatgttactaacctaggaataagagatagtatgcctagtcccttaaaacagtttcaaaagtagatgtaaacatgttttgaacatggattacataattggaataagtttatttcctatctcgttccttcaattctgtgatatttgagaggaaaaagaaaatcaatgctgttactttttagttatgttttattactattaggaaaatatactgataattatttaaaaaggaaatatgaatgaacagactgagctatgtgcataggagaaaaacacattcttttaaaatatatgtgcttatatattctaaactcttaagcatcactttaagagtgtactaaacgtaattattcaatgggacttattacttacttggattctgtcattggcaaaaaatataaataaaacccatatctagacatggtgctaatggaatggagatctttttaaattagatatttaaaacagtgttgtatacatgtctggtcatctggttccaaagatcatttcttaagaataaaaaagttagtatgttttgacaaacttccaacaaatggctgtattagtttcttttttagtgtaattgattattctaaattactgtcctttaatttatagaatgatattgctgtttcatccttaaattgccttgtgagtctactgcaaagtttctctctttctcatctcttattgcatttgagttgtgcggccctgaagctgtgtcacatgccgtaaggtttaaaatacaataacaacatgtatttactaacctcttttttgtgcctgtgtctttcaaagtcagtgggattctgatgttggactctgctatgtatacttatggctagagtttatcatcactgcttagtgattcatttagaaaagaaaatgctggctgataccacttgacatccttaccagcactttgcctttttattttataagtgcttcctttttcaattcgttaaaatgattcacttgagtaactttcaacgtactaggtatttattcatagttttctctaacatcttgaaacgtcccatttttagttcagtctgttaggcgttcatattattagttttctttggacccaggatgtaaataaaccacttctttagatgtgggcttggacagaagccctctgtaggacctaccagctctccatgttatgaggtaacaagattttctcctaccaactcaaaatgtgccacttctttcttaatcttttagcattgcgaacattgaaaatggaaaggatcttaaggaaaagcacaaagatgaactgtcctggtagaatacagtaagccagttgctttggaatgtttttggttagaaaggataagtgatttatgtttgatgcatgtgctcaggactttggtgaagttactaaacttacatgtgtatatctgttctatacctaatcctgatacatttcttagatatatacagccttaagtgtaatcagactacttaaaaaataatatacactgtggtatttaaaaagcatcactgtaattatttggtaggttagttttaagactccttaaataattttgccttttgttttccagctggaaaattattcattgcacctctaattatggttttgggattggcactaggggccatagcggttgtaatcggtaagaaacacttcatgcatctgagattagaattatctgagggccatagagagaatacgagtgtaaatgtaataatatgaatcagttattaagtggacataatttatgttgtatgcctgctttagatagattaccagcatatcatttaaaaggtcagaggagcgtgtttcctgtaggatatgttagtatgaatttttcagtctatgaacactgtgattcatgtaccttataaagcattattaacccttttataacacaaagctaatagaattagtatccttagggaaaaaggcaagtggaatagaacccaaattttctaattctgagttcaggttgaagcatcaaggaaaagaagctctgcaccttatgtgtttcatttggtccagtaaaagatgccataggtacaaacagataatgtcagtgtgtacaggaacatatacccaacatacacttgagcactgacaaatagaaaaccttgcagtgatttgcatagttttatttatgcaagtatattaaaatgtgtattttaaagcagtggttctcagactctagcatgctttagaatatcctcaagggctggataaaacacacattgctggtttcggtctgcagtttctgactcggtatatgggaaaagtccattgatttttatttttaaaaagttcccaggtgatgctcatgcagctggttcagggaccatactttgagaactattgctttagtaattttaagctaaatgctatagataaaggctgctttgatcattgttccatatattagatggggtttttttgctaaataaaatgattttcgtatgtcaacttgggtttagcaagtaataaatgtgcaggacagatagaattataaagtatctgacatttaagttcttgcaatgtgagttaggacattatgtaatagatattattatctgtattatacagttgaggaaattaagacttactggaacctcataagtggtagaaccaggaatcaaacccaacatttggctccacagcctgtgttgttaagtgatatgctatactgcctgaaacaagtgtgagtatcatagtgtgcaaatgatatgactgtggacaataaagaagatttaaaccaaagttttgatatttggatagaaatcattattattaaactggtatcactgagggtgctaaaggggagaaaagctaaagggaaatattaaagaatgaaatattgaagaagtaaatacatttcatagcatagatgtcttcttctttgtatgttcgtacactgcaaataaataaacatagacattttaaaataggaaaacctaaatgcctctcatcctaactaactttaattttttcttatccctaggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaata

SEQ ID NO: 962 - DNA, 47516 bp, Homo sapiens
gtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgttttaaaataagttcccagtgtctctgtgttaccaacaaggccaaatctccattctgtaagaaagcagtcaggttgccgcacaagctggcttttgcctgttttgtcatcatttctagatactcaccaccacaccctgataagctagctaaccacaaagagattcgccactccccagtgcagcgtcgcagctcctggtctgatctccactgggattatcttcctaggcccacctttgctgcctgacaaatgcctaccagctccatggaggacagcacagggtctctcatctctgcagctccccttgaccatttccttggagaccagctcccttctgtatgctcccgtggctcccagctcttctctatcacgggcatctctgcatcccctgacctcctctagatggtaaggcctggtagagcagaaccacttcccaatcacaccccatgaccattttctggacactcaccagcgcggagcccagcacacacaccacgcagtcagccttgactgggtctctgacactaacatgaaattaggttaatccaggtgtttccttcccgaggcaggaaacaccatgaggagcagcacaaaggcactgtgatccagggctggagcacggacagaggcaccttggagaagcctgtgacaaacccaaagcttctgcctcaaacaggccccaggagtggggacagcgaggtaccctagtgtggccaggggcaccccaatacagacaccctcaccctctcctccaaaactcaccagctcctacgtggccagcccgaggctcactgcagggcttcccactcataacgcaacttcaaaagcaacacaccccaggcagaattacaccactaaaaacttccactcctggactcaggtgtgcaggtaagagctatctatagccaacagagttttcaccttccttacccagggcttaactcgggttcagagcacttggagggaggagacagctgcagaattctttgcagcgaagatcccatagcagccctttttggctttgtgtccccacccaaatctctctttgaactgtaatccccaggtgttgagggagagacctggtgggaggtgactggaccatagaggcagtttcccccatgctgttctcacgagagtgagttctcacaagagctgatggttttataaggggatcttcccccttcacttccttcacacactctcacctgccaccatataagatgtgcctgcttccctttatgccatgactgtaagtttcctgagatctccccagccatgtggacctgtgagtcaattaaacctcttttctttataaagtattcagtcttgtgtagtgtctttatagcagtgtgagaacaaactaatacaattatggagacttccctcttcccaggccctgggaagaaatgatatcaacacttctgtctacacagctaaaatctctttggatgttgattctagtcaacagatgtggtacagactaagcagggctcagtagaagcccaacgattgttgaatcatctctgcaagagtgcacgtcttctgcaggtggttagattttcaaaagaaaacacatgcacaaacacacatcatgagcctgtttttaaatgaatgtgtgttaagagtaaagaccctgtaaccagagaggctgggtgccggctggcatttggcactgtgcagacatctcagctcttagtgcctctacatctcagaacaaaggtcgagactccttctagccagccctgcatcctgtgagtggaagcagcggctgcgggttacgtggaggtgagaggctgctctcaagactcaagtcttgcctgtgcacttctcagcaccttccttgcccagggctgacaacaagtacttacctgactgaactccttcccctcacagctatgcactccctgggtgtcatatctgactcaggcccatggccacaaccacatgagggacccctgaaacacatgggccattcattccaactgctgcaccacaagaacaggtacagccttgctgggacctcgtcaccctttgagctgggtacacagacagctgcgaattggaaggagcagctccccctcccatgccttgatgcagcctttgagtccccacgctgtgggccagggctaagcagaacatagaatgcgaagcgagttgttataactgacaaatgacaaaccaacattctcctctgtatttatttaccagcttaggtttcgtcaattgaagaattactacttgttttgagtctttactccctttccctgtcctcatctcctgacaccaggaatgccctcctctactttctccattaatcttcagcctgacagttagatcctcatcttctctaggaaagttccctgaatttctccaggccccaccgaagacccctccctccttcagtcctgagtgctagaactacgcacaaaggcatctgaagttaccaaagagcagagacaaaaaagcatggcaaaggcctgtctcgcccaccagattcttgggggttttgtggggggttttgtttttgtttttgtttctgttttgagacaaggtcttgccctgtctcagacccaggctggagtgcagtggcctgaacacagctcactgcagcctcgacctcgcgggctcagacgcacatcccaccaagtagctgggaccacaatgtgccaccatatctggctactttttttttttttttttagagacagggtctggaactcctgggctcaagcaatcttcctgcctcagcctcccgaagcactgggattacaggcatgagccaccatacttggccaccagattcttaaatgtgtcgagggcaggaacagggtcctccatatggggctgagaccaaaggaaaagtggaaggcgcccagactgtctatgagcctgagaggtgagcacagcgggctggcacagccgccctatggagtaccacaggagggaatgcgctctctaggcaccagctgctctcagggtttaaagtgcttatccaggctcgtttctagctctggtgccaccgacatatagttggggatttccttcagccataagccattccccaaagctgaatgcatccattgcggaagacaccgacgtggaaaattttcaaagagctcacaaagagaagagaacacatctgaggtagtcccaaaaggaaatgtcctttggagaaagctgatggaagggctagagaaaacaagagagagaaaatccccctcgtaatcctgcctgaatgagaaagaacatcatttagggaagctggtttctcgttttctccccactgccaaagtactattttggcatctctttacaactcacagacatcctttcagaatttgtaaatgatgtcccttaattcctgccctacagaaaatacctctgttatgcctccaaatatctgccaagccagtaagcatctattacctgcacatcaatccctaagtgctgtcaaatagcctcagccctcatgcttacagccccccaaacctaacagaccaacaccttttacattcaagactcaaatatgtatatggaagctctgcacatgcaccgagatcccaaccccaaaagcccacacagacacaaatgtcaccttctctcaggagtccccagttcctgctcctgccgctttgaggagttgggatgagaaggacccagcgtgcagcatgagttatgggagctacccacaatcatctttaaactcagccctgcaggaagaaccccaaggctagtgtgatatggaaactccagcatctggagctggctgggactgtaagaacaagcagtttataatccagcagtctccctgaaaaaaccactatcaacaatcactacaggccagtgcagtggctcacgcctggaatctcagcactttgggaggccaaggagggcagatcacgaggtcaggagttcaagaccagcctggccaacatggtgaaaccccatctctactaaaaatacaaaaattagccaggcatggtggtgcgtgcctgtaatcccagctactcaggaggctgaggcaggagaattgcttgaacccaggaggcagaggttgcagtgagccaagatcacgcaactgcattccagtctgcgcaacagagggagactccgtctcaaaaaaaaagaaaaaaaaattagccgagcatggtggtgggcgcctgtaatcccaggtactcgggaggccgaggcagaaaaattccttgaacccagtaggcagaggttgcaatgagctaagatcacaccactgcacaccagcctcagcgacaagagcaagaggctgtctcaaaaaaaaaaaaaaattcactacagtaccttccctggaaagacctggaaggctgtatttcatctcgtccccatcatcaccattcatgtgtccatccaccctctcacttaaatatgcgctgcagcactcacagaactcaacttacctaattcccaaatgggtctctcacagccacccactagcaaagccagagacactgggggagtatctgcagcatttttttttttttgccactgtcattaacactcagcagaatccagaagatgacttcaccccctgccaccatgccctggccccagctcccagatcagtcaatacgtccagccccctgccaatgtggatcaacaaatgtctattttcaaagaaacctaagctggctgcttctggttcactttcctcataactcatcaccaactatttgtgggatgcggagggcaaccatcctgagcctgccccctttgaattaggaagtccccaggtgccagcagtaagaggcactcaaacccagggaggctcacgctacaggggtggctcttgcacacactgactatggggcaagtccctcttcttggtcacccagccagacagactgcagtccaggtcctctgggcacagtgggagtgacagcactagtggcaggccagaccccatacacagcaaagctgtagttcaaatatgtattatatgtgtctggctttcacacggagtttgcaacctgccagttagtagtgtttaccttggtaaaaattcacgggaaatcttagtctgaacaggcccagagtttattttactgccagataaacaactttctttgataaatcatccgtgtgacagtgttcctgaaagactaaacaaagatttcaagcacaatctataggcctttgagaagccttccaaagcgaaggcatgtttaattggctgccctaaggtcggggcagggcaatgatctgacatttctttggccatttgttcttctggaaaaaaaaaaaaaaacagattggggcttccagcacatttctgcaaaactggatgaaacttaccaatatttaaaagctcattcgcattataatgcatagcctattttttggttaaaggaagtgaatatcacaaggcaggtgttggggttggggtaggggaagggaaaagtgccccagagatatcgctggagaaaaatggagaacaaagtgaagtaaaacagcacaaaggggctctgaagtccctcaaacataggccctgctaaattaaaaggagaacgcgttaggtagagtgtttctaaaaaacacacaaatgaaaacttcagtggtcctatcctggaacaccaggcagtcacagctcccgcattcagccctcatcactgtctggaggcttccaggtttacgttgacataaggatgtcatctcactaaaacccagatctcctaacttctagttagggtttggctttccgagggggagttgtttgttattgttattgtgaattacagcaccttgaagctgcataaagcagttctctttgtgggttttgttttgtttttgagacagagtttcgctctatcacccaggctggagtgcagcagcgcaatctcagctcactgcaaccttggcctctaggttcaagtgattctcctgcctcggcctctgaagtagctgggattacaagcgcctgccaccatgcccagctaatttttgtatttttagtagagatggggtttcgccattttggccaggctggtcttgaacttctgacctcaggtgatccacccacctcagcctcccaaagtgctgggattacaggtgtgagtcaccgtgcccagcagcctaaagcttttaaaggtcttccaaatgggttttttaaaagacttcttcagtttaatcctccattaaccagagaattaactagcatattccattcttcttcctaaaaaactttccgcccaacaagctgatttcattagtgctggaattttccttcctaggctaaatttcatcctaaaacatttttttccaataagaagacataataattattacagattgaacagccaccatattccaggaactgtccacacttgattaaatccaattctcccaacacagtcacgtaggaattctcatccatagtttgctgatgaggagccaggctcagggaagttaagagactttctggtggtcgcttagcttatagggtagggatttaatccaagtctgtctcgcccagagcctgtgttctttccattctgctacactgccggctttcccaccaagaagggagccaatgattgctgagctccttccgtgtgctgggcacagacatcagtccatttaaattctacaaaccctaagagtaaaggagcacccgatgccccttcccaggaagctcctcaactaccttcctgcttgatgggtgtgagaggatgggaaggagcaagggtgtgcaatctggcctggatgccagggaagtgctggtgggcagtaacagggatccaggtagagtgctcttgggtcactgaatgcctaactcctttatttttttgtcttatttccttcagtcagtaacgtgagggcacggactggctgatctttgaggtcctatccaactcaacacagctttacaatggcaaagtggtacaggggcttgcttcagtagcacacatggtaaaactggaacaatacagagaagattcacatggccaccatgcaaggataacacgtgagttcgtgaagtgttccgtatttttaaagaataagatacagtcttcagtagcacagctaggcaattatagttaacaataatttattgtatatttcaaattaactagaagactagatttggaacatttccaacacaaagatcagtgtttcaggtggtagatatcccaattacacaatttttttttttgagacagtcttgctctgttgcccaggctggagtacagtggtgtgatcatggctcactatagcctcaaattcctgggttcaagcaatcctcccaccacagcctcccaagtagctgggactacaggtgcatgacaccatgcccagttaatatttaatttttaatggggatggggtttcactatgttgcctggggtcttgaggctggtctcaaactcctgacctcaagcaatcctcctgcctcaccctcccaaagcattgagattacagatgtgagacagcatgcccagccccaattacccagtttgatcattacacattggatgcttttatcaaaatatcaaacataccccataaatatgtgcaactattttgtatccattaaaaaaattttaagtggtacaggtgagcaacgcagcacccaaagaaatgggcagttcacatgagctgtgaacagccccctcatcccactcatcccttttccctctttctctacccacctccagaaaaacctcagaaaataaaggtgaacttgagggcaaatccttctctccactccccttcttatgagagtctatagtcatatccaaagatgaggacatgatgcataacacataagccagatgcaaaaggacaaacactggctcggcctccatctcttcaccgcctacccccccaaccccccacctcccatgcacaagaaggctgctcagaaagagacacaggctctcagctgggactcacacctctagtgcactaagcaatgggccaatctcaggtttttacgcacataaaatatcctaacaattagctccattttgtacagatctgtggatagaatatgtatcttcagcaacaataaaacccagttgttttccacctatcaattccatccccagagtaacaattccttccatgtctaattttactttgactgaatgagattctggatgttggggcttcttttaaacatgtatacatgtatatgctcagtcacccaaaacagggcatgtagttttccttgaacttaatacacaagttgccgacatccaccttgaaaagagccttctcctttataaaaaaaaaaaaaaaaaaaaaaaaaaagaagtccatcatgcctgcaatcccagcattttgggaggccaaggtagggggatcgcttgagcccggggggcggagattgcagtgaactgagatcatgcccctgtgctccagcccaggtagagcgagacttagtctcaaaaaaaaaaaaaaaaaaaaaattccaacatccacgtcccacatcccctgtcattcatacagtcagctgacaaactttcattttatgcctaccatgtataagacactgtgccagggactatttgagtgcaaataggccttactttgttcattccaagacacagattttctgcacatttctgcaagaagtatggtttttttattgttttttgttttgtcagtagtacaaactgaacagtgtgtctcacaattaacaggcatctcccaccaggtaaaacacggcattagatacagagcctgctctcaggcagcctgcaggtgccgcagtgactgtgctagcagccatcttgcttcatctttgggaggaaacccaaggtttagtttggaaaggctgagcctactttctgcaagaactcaaactgcccgtcagagtaaaacactgtcccccaaacagcagcacagccaagacatcctgaaagaagttggaggcagagtgagaacagattagtggaggtacggaggtgcgggaaactgaaaatatttctactaggaaatactccctaatgctaactgtgaaagctgatgttcttttccttcctatttgactaaccttagtgttgcatagtacagcttttctctttatgaggaaatatataaatggaaaaaagaatccttccagaaggcaaggaaagtttctaggggcaaagaaatccttttccatagggagaaaatactgggctgaagaaattgccacctgaactctcaagctcaaaacactgaagaaggtagtacaagtggaagctctgaactctcctagcagaagtgtatcaccatgcaaatttcccccaggaaagcttacgggtgtttacagatactgcagaagaagctagagaaagtggccagaggcaggaattaacctcaccacaattataaataaatcagatcctcatatccctgggataaaccaacccaaagggaagacggctgtgggtactgagctgttaacagcaggatgattagtgtggcggctcgcaaatactatattgggctatttaagaggcgagagtggcaccctgttgtcacagagcaggaaaagcagagagagaacaaaaagcagagccctgcaagctgatggaagccagcaggcaggctggtcgccatgttcgatgcggtgactttgccccatctaagtcttggctcccacatctggtgcttgatccaggctgatcagctgcattcctgagcatcagcacacaagcttttctgctcatgtttttttcctgttggggaaaaaatgtgccctgaactgagcaggtacagtgcagggctggagacatgagtgactaagcagatctgccaaggggttaaagcacactgcatgccgagaaggtcaggggtcagacatgcccagctccacagaggctcccggagaccacagatgcagtggcagggggacgagggtgctgcttacccagggaaatgcaccccttgttcccggagctcacagagagccttccagcaacctgatgtcttcccactggggatgtcagggccacttaatgcaaagtttgatccctggaggagggagtcaagcattctctttcttctctgctgtgtgtcagcttgcattgttcaatttctttgtttcctaactgaatcccatcagtgtggctgactgcctcacttacttgaagtgagctgagctaggaaacacgtttctcgacaaggctgcattctctaaggtgctaagaagggcagagctaagctcagcccctacagagagagagaaaaaaaaatccctatatattgttttatgagaacattacagacaaaaaaacaaaaaggtttctcctgcaaccagctcaaagaagcctgccatacaccatacgcacactaaggaggtcagcgcctccgtggcagagcccagcggctgtgcatcaactcttaagtgaggagggcaggtggcagagtgtaaaaggactccagttgagaaagtcaaattccttctttatcaaataagaggactggataagatgacctctgaggtccaggaggaacccaaaagttctgtgaacccaagaggaaaatattgtcagggctaaaggaacccaatcccaaacagctaatcactcagattccacaaaccgtgactggttatcgacatgagatcctctgtcctcttctgtgtacagaacgctggctgatttggcaggtgcctgctgccgtgggaagaagatgtccatcccagatgagttacctgagtgccctctagacccctgccctacaccttaaggtcaaccttgccagattcaaattctttcccaggcttgcctcttcagcctatgtggcaaagggtctgaatcctccaacttctgtcttttttaaaaaacaatactcatgtattacatttatttagaggaagagttccaccctcaatctgtatctatagaactcagaaagcactaggtatacagggaatcctcactgatgaatttgagttaatgcagaaacagacaagtaactcacactgctgcatcacagagaacacatcaatcttccccatgcatggaaacaggatacgcgctctccagtttagctctggtggccatctacatccagcttccatcttcatccacaattgcaataccctgagaatgaccctgtcgtgaggcatgattccctccgacttgcatgtgtcctcccacatgtgtgcagcttactttgacagggcaggaacaagacccttccgtgtactttaccatgttcgattaatgaaaacatggactgggatgcctccgaatggactcacatcacctatctttacgcttttccagataagaattctgtaagaaatccgatctcagggacacaaggcaggaattatgagaaacacgttgttcagcatcacactgagtcttctgaaagtgtggcttggccggagccacttctctgcatccatgtcagatagaggcgagagagagggagctggccctccaaaggggtgccgtttacatttacttttctcagaggagagactctcagggtgtggtgaattcaggtattctgcaggtcagactataacagaccatccctggaaggccccaaggcccctggcatctcccccacctccccctggcccccaccagctcctccttctcctggagctgcgagtgctggttcagaattctctttcgatggagagtgacttgggaagaagagagaaaaaccaccctgctgtggggatgtccatttttctttgcctcgcggaacctgatgaggacccccactctgaatcccctaagcattgaactctcccctccctgggaaggcacccagagggcagccatttaaatcctggacagagtcatgctgacacctaggggtagatgttaaaaaaaaaaaaaaaaaaaaagagccagtccggaaaaaaccgggcccaaccagacacagtagcaggtggcaacttgtactccctgcagcttctgagaaggagctgctgtccttccctgctcctctcgacctgtccccaaatcagcctccctgcatgcctagagaagatgcccaaaaatctgtccagcgatcccccacaaaggagggcaaagtatggccttcatcaaaactggccggttctggaccctgtctagtctcccatctgcctgagaaaagcagccatttggagaggaatgaggtagagaatatggaaagctgcaacgagatacatcagcagggcctccgtctggcagaggcacagaccaggaggttccaaaccttccagaggcagctagaaacgctttcttaccaaactcgctggcacagagatgttcaatgatggcctcagatttcaactcgttgtcacagggaggacacaccgttgtgcctgggaaaggaagtagggagaaacggaactgtaagttacagagcaggaagggagcagcccctggggaaaagatcggccctgggtccaggctgaaagtggctaaaggtcttctggaacttctgaaggggacctgagaattgaaaacaagaagccttgagcccagggtctacaaccagagcaggcgcaggtttcttgaaacattttggcccagagctgctaaatgtgacacagttatttaagccagcataacctgaggctgggtgggtgcaggtcacatgaatgatgacttgtggggcgctgtgagtgccgggaaaagctggcttacaaacccacagagatctcttcctggtgtttgtttcccatcctctcccttctcctttcaataccatcctccgattcctgcccccttcccatttccacactcccagctagcctgctgatccctctgaccaggtctccaggagccaagagagaaagaaactcagccagactcacaaactccagctctcggcccctgaacacctcctctccaaaagggccaccgcagcaggaggccagggcaggcgggcggggtggggcactaacaggcgctgccaaatgggaggacagggctggataggaaggggtccttcagaggctctttcctgggcaactgtgaagtgctttgaagaggaggtttgtgggggcagacgtgcataacgttggaaggcagctccactgcctgggaggagatgtctgaggccagggcagaagcctcctccaagccaatatactgctgaagtcagaaaatccagtggaggtaaaggactccagcttcccaggacagagggagagcaggacggcgctttcctccaagagctgaagtggcttatcatcattgtcatcaccttcacctatcaagcagcctggagcttatcgactgtctaggaaaacatcacgagcacattctaggggcaccccacccccgggcacagcacaggaggccaagccaggctggagctgaagagcacaggaaagtcaccgctgaccctgcactcggggagtgcaggtggggcttggtgtgcttggagcccactgctcttcatcctcctccaccatggcttccgtggcagcatctccctccccatcagccccccttatggctcagacattgaaataggcaaaggctccctaagtggaagagaagaggggacctgcagagcacccccagatcaaggctgccctcaggacacaagtggcccatagaccactccctacttccaaacagggtccctgcagggcccagcagagaccccatccttagtttttattgacacattcctctcccacctttactctgcacccaggagcaaacaccttccagattctcagtgcagttaagaaccacgctcccagcagacgatggcatgactgtccttagcccagatgctggaaatttgctttgcacccagaacttgagactgggttctagaggtggtaattctcacaaaggagacaacttaccacaaattttgcattatggtttttgcttccacatggggaaaaggaagtgtgacaatatggaaaggaccaggttacttgcacaaggagagtgaactgtgcttttgggttttccttgtttaggttattttgaaaaaggaaaagtgggagttacacaaacacacatagcaacgttctgtgaatacaatcttgaccaaatagtgaagtcagggtgatccaaacataaagggcacatctctgcccgctccacacactcactgcatctcctctggacacttgaagttcgcctgaaccaatcggccaaggagggctctgcacttctcagggacattttcctcagtcccgtcaattacatttggacttcagtgcctctcagaatggcaggagctcgttggggtgggctctgtgtgtttttaccacggctttcccctatctcagcttttctaacggctgactctggagcagcctgatccagagagagaaagagaaatgtgtgatgcggtattaacctgcgcctcattggtgcgtcttggggctctacaggctgcctctgcaggagaaatccacccagtcatccttctgagaggtggaactaaatcgctgttttcagttgtatttaaaataatgtttaaagcaaatgaacaaaaaaagcaaaggttttgtgtttattaatatttaagggtgtgtggaggagacagcccaacagctgaatcaggattaagtgatttttgtgatacatcaatccacacacacacaagtgctttctcagtctctctctctttcttctctctttccctttctcacacacaacccccacaatcttccctggccagttcctggggggaccaaaagggagccctaaggaaggctttctggggaacagagggctctgtggcctctgccacactgactaaatgcacaacatgcccaagcaacaacaaaatcaaacccaatgtgctggctcatacaacttcacccagtaaaaccaggcagagagggaaacaacaatgcatcagcctgggagttcacagttctaatggaagtgccaaattcaaaaatgacttccctagaaaaagagcaattgcctcttccctaacaggagcttctatggcttgggtatcagcctttgcaggggaaaaatgtcaagtcatttctcattatcaggtttctccttaataacacatgaccacagacagctggccaataatccaaaactgaatttgcccaagtgtgtgaacagaaaccagtatgcaaagatatgacactgctttgaaaatgcattttaattttaaagaataaaagcataaagaataaacgaataaaagagtagtgcatgcatacttattctcattggaaagtgccagttacgaccccacagccacaagccataaggttatgaggatcagtagtctggtttgtcttgacctgccctctacacacctacacacacacacacacacacacacacgccccaccctcccctccacagggacctcgcaggaaatcacgtggggctcccttacaccagggattgcagtcctggggagggtggtgtgccatctcagggcagagccccccaccaaaaccactgaggggaaaaccagtcccaagccccactcccgaccggccctctccccacttttctctttgctcctcaaagacctgtcttgggagggtgactacctgagcgctgctgggaggagtggaggtgagtgaggacggttccaagccaggctgagaagggcgccgaccagtggaactgcagccaaggggcaaaaggtgtccggaagacagcgattatggggtttccccatcccatcacagccttttgggggctggggtgagggattctttcctctcttcttcaggcaacccgtccaatccccccatgttccctgtggactgcagcaccttttccgcagccgagccccctaaggtgtccactcatgtctgcagacggtcccagaaagagaccatcggaagccattgggaatggactccaggtcagggctgggcacagcctcacagggcagggctgggctaatccccgctggctgaggaaggggagaaggaaattcccgcaggctgcaggggatgggtgcaagccaacagaacacaaggcgctttgtttgctccaggtaactgctcagttctcgctcacaaagtgcagatgcatccgctaccctcactccactcccaacaccagagttgactctgagagcagcggtgcccagacctggccactgcgggcaatcagtgccgttcccatccagccatccaacgacagtcactgtggacccatctccaccctccctagaataagcaaaagcatctaaaatttggggtatccctttcccccacctgcccaaatcctcactctgaggagccaggtgactgcactcccctcttttagcatcaataacagaggttaaagacactttaaggtgagctaagtgtaggcagtctttctcccccaccctaaaggccctcctcaaaaagccctcaggaagcctgcgtctgtgctaagcgcagctggggtacagctccccaatccctgaccctctccacacctcagagcctaaacttcgcttctaaagaattctgggttgaatttacttctatagaagtcaggtctgtgatgtgtatattttatctttatatctatttcattttatttgacttcccaggatttttttttcttccccctcaagaattgctctttaaacataagggggttttgagaggaacctcgggccggtccctcaggctgttaggaaagtctgcattttgcagagctgctctccccgggaggagatgaacaatgagctaattacatttttatctttctaatgagctgaggatttgtgtaaatgagaaaagcagggggtacgctagagggagggagaaaagactttccacccccagccctccgagggcagagctggtacctggaaggggtggagaaacagaagtccccacggttcctaaactttctcagccagttttgcagcaatcccaaggctacttgactgaatgaccagtgaaggaaagggcttggttttattttttaaatctttgtcgaacctatgaaaataaacaaaagctgctccaagcattctctcggcctttctgaactttctacgctttgggtttttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgc

SEQ ID NO: 963 - DNA, 10326 bp, Homo sapiens
caatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggtaccaagccggggggctggccggccccggggcccggttggggtggggatgtgcaaagggagcccgggaggaccgcagagccgaggcggaggtgagaggctgcgagtccgcaggaggtgtgtgggaggggatggctcctgcccggggagggccgaaggggaggggccgccggggaaatgtggggagaggggagatcccgcgaacgctcgcaaccgtggggaaaggcgcagaggtgggagtgaccggcgccagagaggaagagggcccttgctgagtgaaggggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgctggttggaaggacaggcagggttagggaccaggtaagggagcggggcaggagaactggtgctgccctgagcagcaggaacctagtcctgcgccggccgtgagtcttccatggcatccactgggaaccacatgctcctggcaggacccgctgcagaatctcctgccgttaggacaagtggggtttccagccctagggagaatctatgcttggatggggtttgggggaagtcagggaggcttgcagaggtacctaggaattcctcttctgccagccagtgaaaagtgttgaggaaaggagtcattttggggtgtagacgataagggaagagatgaaagcagaggaactgggagacaaggagctggatccttgggaacactggctggtgtttatttctgtcccatgtagaaaccagagctgcttccaaggtggtttgcagaactttgttgggagagtatggcatctatggggccatccttgaaggtccccttcctgggctcatggcaggatgtttagtgctaatctaggtctcgtctcccatcactccagacactgttgtatcagtgtcccttgtcacttgatcatcagtggagaagattgtggggggaggtaattaaggaaaactctcttctctccttccataaccttcttcccaagacaaaggagtaagggcagtaaagtattacagggcaaaaggagaaactaggctgtggcaacaagttggagcctgtgcagtttctggaaagaaacatgggacagttggagcttaaatggtccattatcactaatgtcttgtacaaattccagtgtgataggtagggatccatcctggtccctgtgacagtgagaaggggtgaggctctgggacattccaggcactaagctgtgttggggagcagctagctgggtccttcgtatcccctgaagttatatgttccatcactgggggctgttactgtttgcttggggtatcttcaggtcaatggggctgctcctcaaaggaggagcatgggtagttttgctgcttccagagatcctgataggacaccctgccctcagagtcattagagacgaaggtcattatgggaatgggggaatgacatcactgtataattctttttccaacttctcaaggaaggtagagataaaaagtttgctgacctgcccatctccctcctcacccctcaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggtgtgtttgggttgcctatgtgagaggagggaagggagtggggtccctctccctttctggcccaggacaggtggataggtgcccaccgatgtggagtggagccggattaacgaccctcgtcctaggggacaggtgtccatcctcactttcctgatagaagaccgcccccctagataagcgggcggcctccgtgcccatataaggccggcttgggctccacgccggcctcccgcccgcagcccgcctgcctggcagggcctttgcattcctcccgccagctgtctccccgctaggggcgggggtgtagtttagcccggccctccgggctgggtcgccagggagtagaaagggagcactccggtcccggggtcctgggaatccagcactcttggcaggcgggctggttgactgggccggggactaccttacaagccagccgctgccctttcagggtgttgggggcctgggcagttagggagcgcatttgcctgctgctagggatgcctgcgctgttactcctcccccttccttttcccggtaaggagagggggtggggcttcctcccttgctgtctggggagctccaccttccgggtggcacttaactgactggccaatgggaggaagcggcactgtttgccttagcaacgcctctgccaatcaagggtcttgggcccagctgctttgcaaacgtctcgtgctgacccaccccgcagcctttgagcctctggttgactcatttcgggtctgggcttggtggcttggttctcagtttccttcttccccttctaagaacgaagtcttccttaggggagagtcagtgctgtaggctacctcctctcttagtggcatatcatctgtaataatttttaaacttttataacagtagggctcatttattcccaggaaattttgttggatgagtacattcttttggtagtttacatcttgggtgtttgacatatagtgtgtcattgccagattctcaagatctctctcaaactcttaagttccctgagaaactcagttcctatctcagaagcctgacaaattagagctggaagaactctttgaaagaaaacgtagtagcccagccccctcatgcttatagaagaggaaaaccgaggttcagaaaaggggactggttatttcagggtcacttagatggtcattaccagagctaggaacagaccttggtgtcctgactccccagccaatgggattaccacagtccgctggagcagagaactcaggggattataataatgacaatgataataattatcataagagcagcaaatatttattttggtttttttatgtgccaggtagtgttttctaagtgatttacatatgctaacctacttaatccttacagcaacctagggggtaggtattatcctccttttaccgatagaaaactgtagctcagtagatcaataacttacctaagagtcaggcatcaggtaaatggtggcgttgggatttgaacccaagctcactggtttcagtctgggttctcagtccacacaaagcttctgcaaaggcaggatctggtaggggctcattgcttcatctttactctgggtataggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttatatcccgttggcaggcatacctctgcccactgagacccctgctgtccttgtcagtaagtttcaaccatatattctggccctgtctagctaccccagccccgtgccctcattgccacagggcagtagatgtttcaccacttcctgccttgactggaaggcagatcatgtctttgatgggttattgccagctcttgggtcaactgaagaaaagagagacaaggcccagggcaggaggaggagggatgggcaagagtagagcgtggaagcccccagagtggatacttgggcctgaagggcctctttggcttccaggaaagatagtgatgggagttggagaccagtgtgccagaccctgggactggggtgtccatgggtacttggtggaggtggcaattgggtgggacagagcacaaataagactctgtgtcttgcaggtggggcagtggcccagcaggtcccagtgcaggccattcaagtgcaccaggccccacagcaagcgtctccctcccgtgacagcagcacagacctcacgcagacctcctccagcgggacaggtatagctcgcagccctgtcaccctccctccctgccttcccccacgaggcctagcagtaggtgcccaacagtaaccctcctgtaactaaagtcaggggatttcttaaagtggagattgaggctttgggcctaataattatggggaagtcaggtgaggatgactgggttttgaatcccgccctgcagtgggctgcggattccagaagaaaattggggaccattgacctacctcctcattcagatgaggagcctgaggcctagaaataagaagttacttgctcaaagacacatttgcttaattatcaggaaggacttagagagcaattttctctttgtgcgagggtcttacaggttttgagtagccacagttaccctcaggtatctctagacatttcagaaatgatgagatactctcaaagtaaggttaattttaagttcttattatttataacctttttactcaaagtgtggcctatggactgggaacaccagcattacctgggagcttgttggaaatacagaatcttgagtctcaccccaaacctagtgaatcggagtctgtttttttttttttttttgagacggagtctcgctctctgtcgcccaggctggagtgcagtggcaccatctcggctcactgcaagctctgcctcccgggttcacgctattctcctgcctcagcctcccgagtagctgggactacaggtgcccgccaccacacctggctaatttttttgtatttttagtagagacggggtttcaccttgttagccaggatggtctcgatctcctgacctcgtgatccgcccacctcggcctctcaaagtgctgggattacaggcctgagccaccgcacccggcccagagtctgtgttttaacaagattcccatataatgcacgttaacatttgagaagtgcttgtttgaaagatgaatttgttagctgtgcattaagaaggagagagaggccgggtgcggtggctcacgtctgtaatcccagcgctttgggaggccgaggggggcagatcacgaggtcaggagattgagatcatcctggctaacacggtgaaactccatctctactaaaaattcaaaaaattagccgggcttgatggcaggcatctgtagtcccagctactcgggaggctgaggcaggagaatggcatgagcccaggaggcggagcttgcagtgagccaagatcgcgccactgcaccccagcctgggtgacagagtgagactccatctcaaaaaaaaaaaaaaaaaggagggagaatgagaacaaataaaaaataagatgttagagctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 964 - DNA, 6402 bp, Homo sapiens
cagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 965 - DNA, 2907 bp, Homo sapiens
tgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagc

SEQ ID NO: 966 - DNA, 6555 bp, Homo sapiens
tatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 967 - DNA, 7149 bp, Homo sapiens
tgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 968 - DNA, 7430 bp, Homo sapiens
actcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 969 - DNA, 28589 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacat

SEQ ID NO: 970 - DNA, 29565 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 971 - DNA, 30240 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatctgctcctcccggaaggcagctccccccttctccagtctggctctgcccctcctcctgccctcacagacctcccgcccttgattccgggatcagaggaacccaccccacccccatctccagctcaggcacagagcaggggctggggccccacacaacacacagggcggcttgtctccagcggtatagcctctccacacccccaaaccgtttgctcgaaacttgatctccttggccctcagagtcacctcagtggagaagcctgcacagggctttgatggctgagtttccccagatgtggccttagagaagctgaggaaccccctacttacctccatttgtccccatccatcactcccagggggccactgcctgatgaattgccagaggggaaccaccagctcggctcttaataaccggatctgcatcctgctgctgcccagctgggctgagggccctgaccacagctaaggggagtcatcacagggcttcagggctggaattccaggtatgatctattcccaggggaagtgaaaaaggccccctcggagctttctcttctatttctcacttctcacagacaggctggggttctggagtcctgctcttcaccccaagtacatgcctgcaacctccaacgctgctggacagtcggctgcatcccccctcacctgagcac

SEQ ID NO: 972 - DNA, 23750 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaacccttttt

SEQ ID NO: 973 - DNA, 29565 bp, Homo sapiens; identical to SEQ ID NO: 970

SEQ ID NO: 974 - DNA, 23414 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatac

SEQ ID NO: 975 - DNA, 2309 bp, Homo sapiens
acaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 976 - DNA, 3127 bp, Homo sapiens
gaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 977 - DNA, 14644 bp, Homo sapiens
tttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 978 - DNA, 23414 bp, Homo sapiens; identical to SEQ ID NO: 974

SEQ ID NO: 979 - DNA, 668074 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctc
